United States Patent 11,098,302 (IDENTIFICATION OF POLYNUCLEOTIDES ASSOCIATED WITH A SAMPLE) - sequence listing, part 128

SEQ ID NO: 445730 - DNA, 464 bp, Homo sapiens
  misc_feature: HEFZJCU01B2XI0.5.86.H09.1.454.heavy.3.raw
atcagacacgcacgaccggtgctcgatttagtgctatagacttgggtttgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatcggtcttcccctggcgccctgctccaggagcacctccgagagcacagcggccctgggctgcctggtcaaggactacttcccgtgtctgat

SEQ ID NO: 445731 - DNA, 387 bp, Homo sapiens; identical to SEQ ID NO: 444635
  misc_feature: HEFZJCU01ALDOX.11.27.C05.1.454.heavy.3.raw

SEQ ID NO: 445732 - DNA, 404 bp, Homo sapiens
  misc_feature: HEFZJCU01CCOI3.53.61.F06.1.454.heavy.3.raw
cgcgtatacacacgaccggtgctcgatttagctacgctctaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccatttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 445733 - DNA, 398 bp, Homo sapiens
  misc_feature: HEFZJCU01DAGDH.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggcctggcctggtcaaggactacttcctacgtgagct

SEQ ID NO: 445734 - DNA, 479 bp, Homo sapiens
  misc_feature: HEFZJCU01AC05X.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggatacttcccacgagagta

SEQ ID NO: 445735 - DNA, 374 bp, Homo sapiens
  misc_feature: HEFZJCU01BT4RM.49.41.D08.1.454.heavy.3.raw
agtcgagagacacgaccggtgctcgatttagtcacgcgagaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctcccgagagcacagcggccctgggctgcctggtcaaggactacttcctctctcgact

SEQ ID NO: 445736 - DNA, 527 bp, Homo sapiens; identical to SEQ ID NO: 445522
  misc_feature: HEFZJCU01B2G4P.12.39.D06.1.454.heavy.3.raw

SEQ ID NO: 445737 - DNA, 502 bp, Homo sapiens
  misc_feature: HEFZJCU01BPU45.49.80.H03.1.454.heavy.3.raw
agtcgagagacacgaccggtgctcgatttagctgtgcgtcgaaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcctct

SEQ ID NO: 445738 - DNA, 495 bp, Homo sapiens
  misc_feature: HEFZJCU01EEXV5.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtccaccgtctcctcagcctccaccaaggcccatcggtcttcccctggcaccctcctccagagcacctctgggggcacagcggccctgggctgcctggtcaaggactacttccgagtagtaca

SEQ ID NO: 445739 - DNA, 406 bp, Homo sapiens
  misc_feature: HEFZJCU01C3PPY.12.27.C05.1.454.heavy.3.raw
atacgacgtacacgaccggtgctcgatttagacgcgatcgaagggtttgggtgcccaagctgctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgtccttgagtactggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 445740 - DNA, 372 bp, Homo sapiens
  misc_feature: HEFZJCU01DR0ZQ.49.29.C07.1.454.heavy.3.raw
agtcgagagacacgaccggtgctcgatttagagtgctacgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggactccctggtcatcgtctcctcagcctccaccaagggcccatcggtcttcccctggcgccctgctccaggagcacctccgagagcacagcggccctgggctgcctggtcaaggactacttcctctctcgact

SEQ ID NO: 445741 - DNA, 403 bp, Homo sapiens; identical to SEQ ID NO: 444658
  misc_feature: HEFZJCU01DAJWH.14.60.F05.1.454.heavy.3.raw

SEQ ID NO: 445742 - DNA, 536 bp, Homo sapiens
  misc_feature: HEFZJCU01DUWST.48.43.D10.1.454.heavy.3.raw
agtatacatacacgaccggtgctcgatttagactagcagtaagggggctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgcgcctggggccagggaaaactggtcaccgtctcctcagcttccaccaagggcccatcggtcttcccctggcgccctgctccg

SEQ ID NO: 445743 - DNA, 528 bp, Homo sapiens
  misc_feature: HEFZJCU01ASDLX.51.34.D01.1.454.heavy.3.raw
cgatcgtatacacgaccggtgctcgatttagatcgtctgtgttgggtttgggctgagcgtggtttcgtcgtaggctctttaagtaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagccctccaccaagggcccatcggtcttccccctggcaccctcctccaagagca

SEQ ID NO: 445744 - DNA, 425 bp, Homo sapiens
  misc_feature: HEFZJCU01AWU95.16.53.E09.1.454.heavy.3.raw
tgtactactccacgaccggtgctcgatttagagagagtgtgttgggtttgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445745 - DNA, 397 bp, Homo sapiens
  misc_feature: HEFZJCU01D2GIW.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctccctcagcctccaccaagggcccatcggtcttccccctggcaccctcctccaagagcacctctgggggcacagcggccctgggctgcctggtcaaggactacttcccatactcgta

SEQ ID NO: 445746 - DNA, 371 bp, Homo sapiens; identical to SEQ ID NO: 444919
  misc_feature: HEFZJCU01AWET7.3.1.A01.1.454.heavy.3.raw

SEQ ID NO: 445747 - DNA, 505 bp, Homo sapiens
  misc_feature: HEFZJCU01B8Y4S.49.55.E11.1.454.heavy.3.raw
agtcgagagacacgaccggtgctcgatttagcactcgcacgttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaaggcccatcggtcttccccctggccgccctgctcc

SEQ ID NO: 445748 - DNA, 500 bp, Homo sapiens
  misc_feature: HEFZJCU01C3RZJ.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacgggaaagcttttgatctctggggccaagggacactggtcaccgtctcttcagcctccaccaagggcccatcggtcttcccctggcgccctgct

SEQ ID NO: 445749 - DNA, 464 bp, Homo sapiens
  misc_feature: HEFZJCU01EUBBK.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctgggccagggaatactggtcaccgtctcctcagcctccaccaagggcccatcggtcttcccctggcaccctcctccaagagcacctctggggcacagcggccctgggctgcctggtcaaggactacttccgagtagtaca

SEQ ID NO: 445750 - DNA, 537 bp, Homo sapiens; identical to SEQ ID NO: 445697
  misc_feature: HEFZJCU01CMEL2.14.57.F02.1.454.heavy.3.raw

SEQ ID NO: 445751 - DNA, 313 bp, Homo sapiens; identical to SEQ ID NO: 444518
  misc_feature: HEFZJCU01ED48P.7.10.A10.1.454.heavy.3.raw

SEQ ID NO: 445752 - DNA, 476 bp, Homo sapiens
  misc_feature: HEFZJCU01CTMBL.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 445753 - DNA, 356 bp, Homo sapiens; identical to SEQ ID NO: 444460
  misc_feature: HEFZJCU01CR7TD.47.38.D05.1.454.heavy.3.raw

SEQ ID NO: 445754 - DNA, 516 bp, Homo sapiens
  misc_feature: HEFZJCU01CPDUG.48.19.B08.1.454.heavy.3.raw
agtatacatacacgaccggtgctcgatttagtgagtcagtaaggggggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccaggggaaccctggtcaccgtctcctcagcctccaccaac

SEQ ID NO: 445755 - DNA, 506 bp, Homo sapiens; identical to SEQ ID NO: 444674
  misc_feature: HEFZJCU01D0WET.12.33.C11.1.454.heavy.3.raw

SEQ ID NO: 445756 - DNA, 490 bp, Homo sapiens; identical to SEQ ID NO: 444500
  misc_feature: HEFZJCU01EN3E3.19.53.E09.1.454.heavy.3.raw

SEQ ID NO: 445757 - DNA, 396 bp, Homo sapiens; identical to SEQ ID NO: 444426
  misc_feature: HEFZJCU01C169X.18.31.C09.1.454.heavy.3.raw

SEQ ID NO: 445758 - DNA, 425 bp, Homo sapiens
  misc_feature: HEFZJCU01B5YEZ.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccacgtatca

SEQ ID NO: 445759 - DNA, 524 bp, Homo sapiens
  misc_feature: HEFZJCU01CBAAJ.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacgggctgtgtattactgttcgtttggttctgactcgtcgggggaagtaccttcagcactggggccagggcaccctggtcaccgtctcctcagcctccaccaagggcccatcggtcttcccctcggcaccctcctccaagagcacctctgggggcac

SEQ ID NO: 445760 - DNA, 513 bp, Homo sapiens
  misc_feature: HEFZJCU01B1JAZ.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagcggtggtttcgtcgtaggcgtactttaagtaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattctgtgcgaaactctcattccttcatctgaatactggggccaggggaaccctggtcgccg

SEQ ID NO: 445761 - DNA, 387 bp, Homo sapiens; identical to SEQ ID NO: 445235
  misc_feature: HEFZJCU01BVXMU.9.63.F08.1.454.heavy.3.raw

SEQ ID NO: 445762 - DNA, 449 bp, Homo sapiens; identical to SEQ ID NO: 444889
  misc_feature: HEFZJCU01BYFT0.9.53.E09.1.454.heavy.3.raw

SEQ ID NO: 445763 - DNA, 396 bp, Homo sapiens
  misc_feature: HEFZJCU01EQCEA.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctggggcacagcggccctgggctgcctggtcaaggactacttcccatactcgta

SEQ ID NO: 445764 - DNA, 484 bp, Homo sapiens
  misc_feature: HEFZJCU01CKAK8.10.35.D02.1.454.heavy.3.raw
catagtagtgcacgaccggtgctcgatttagcacacgatagttgggtttggggggtcccttagactctcctgttcagcctctggattcagtgtcacttaacgcctggagtgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggtaaagcgatgacacaggactctattattgtaccactaagagtcccacgaagactgtgggaaggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 445765 - DNA, 311 bp, Homo sapiens
  misc_feature: HEFZJCU01APHMS.4.20.B09.1.454.heavy.3.raw
agcactgtagcacgaccggtgctcgatttagtgtagtgtgaagggccggttcaccatctccagagacaacagcaaagactccctgtatctgcaaatgaacagtctgagaactgaggacaccgccttatattactgtgcaagaggcggtgtgggaggtagtcttgactcctgggaccagggaaccctggtcaccgtctcctcagcctccaccaagggcccatcggtcttccccctggcaccctcctccaagagcacctctggggcacagcggccctgggctgcctggtcaaggactacttccctacagtgct

SEQ ID NO: 445766 - DNA, 482 bp, Homo sapiens
  misc_feature: HEFZJCU01BK09I.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttgacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 445767 - DNA, 486 bp, Homo sapiens
  misc_feature: HEFZJCU01B6YZ1.10.35.D02.1.454.heavy.3.raw
catagtagtgcacgaccggtgctcgatttagcacacgatagttggggtttgggggggtcccttagactctcctgttcagcctctggattcagtgtcactaacgcctggatgagctgggtccgccagtccccagggaaggggctggagtgggttggccttattagaagctagacctgatggtgggacaacagagtacgctggattcgtaaaaggcagattcggccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggccgccctgcctccaggagcacctccgagagcacagcggccctggctgcctggtcaaggactacttcccactactat

SEQ ID NO: 445768 - DNA, 533 bp, Homo sapiens
  misc_feature: HEFZJCU01A9OOQ.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgttgctattttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctc

SEQ ID NO: 445769 - DNA, 492 bp, Homo sapiens; identical to SEQ ID NO: 444827
  misc_feature: HEFZJCU01DNSVW.4.28.C06.1.454.heavy.3.raw

SEQ ID NO: 445770 - DNA, 486 bp, Homo sapiens
  misc_feature: HEFZJCU01BNG93.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccagttgaacatgactatcactactac

SEQ ID NO: 445771 - DNA, 379 bp, Homo sapiens; identical to SEQ ID NO: 444450
  misc_feature: HEFZJCU01ENIWM.47.77.G11.1.454.heavy.3.raw

SEQ ID NO: 445772 - DNA, 464 bp, Homo sapiens; identical to SEQ ID NO: 445062
  misc_feature: HEFZJCU01BQ5C2.19.10.A10.1.454.heavy.3.raw

SEQ ID NO: 445773 - DNA, 378 bp, Homo sapiens; identical to SEQ ID NO: 444419
  misc_feature: HEFZJCU01ASAKH.47.77.G11.1.454.heavy.3.raw

SEQ ID NO: 445774 - DNA, 508 bp, Homo sapiens
  misc_feature: HEFZJCU01DICIR.48.57.F02.1.454.heavy.3.raw
agtatacatacacgaccggtgctcgatttagctcgatatagttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttcccctggcgcctgctccaggagcacctccgagagcacagcggccctggggctgg

SEQ ID NO: 445775 - DNA, 396 bp, Homo sapiens; identical to SEQ ID NO: 444469
  misc_feature: HEFZJCU01BJOJU.47.46.E02.1.454.heavy.3.raw

SEQ ID NO: 445776 - DNA, 514 bp, Homo sapiens
  misc_feature: HEFZJCU01EJHIP.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccc

SEQ ID NO: 445777 - DNA, 403 bp, Homo sapiens; identical to SEQ ID NO: 445456
  misc_feature: HEFZJCU01ACLG3.3.72.G06.1.454.heavy.3.raw

SEQ ID NO: 445778 - DNA, 488 bp, Homo sapiens
  misc_feature: HEFZJCU01CYCY4.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcgccctgctccaggagcacctccgagagcacagcggccctgggctgcctggtcaaggactacttcccatactcgta

SEQ ID NO: 445779 - DNA, 336 bp, Homo sapiens; identical to SEQ ID NO: 444510
  misc_feature: HEFZJCU01D22YX.3.31.C09.1.454.heavy.3.raw

SEQ ID NO: 445780 - DNA, 517 bp, Homo sapiens
  misc_feature: HEFZJCU01A8MS2.19.26.C04.1.454.heavy.3.raw
  modified_base (514)..(514): a, c, t, g, unknown or other
tactctcgtgcacgaccggtgctcgatttagtctagcgactttgggtttgggctgagcggtcggtttcgtcgtaggcgtctttaagtaaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggttttggacgtctggggccaagggaccacggtcatcgtctccccagcctccaccaagggcccatcggtcttccccctggcgccctgctccaggngca

SEQ ID NO: 445781 - DNA, 507 bp, Homo sapiens
  misc_feature: HEFZJCU01BK9QY.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 445782 - DNA, 482 bp, Homo sapiens; identical to SEQ ID NO: 444503
  misc_feature: HEFZJCU01A224S.7.10.A10.1.454.heavy.3.raw

SEQ ID NO: 445783 - DNA, 489 bp, Homo sapiens
  misc_feature: HEFZJCU01BHX8S.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctggctgcctggtcaaggactactcccacgagagta

SEQ ID NO: 445784 - DNA, 518 bp, Homo sapiens
  misc_feature: HEFZJCU01DFW65.19.26.C04.1.454.heavy.3.raw
  modified_base (512)..(512): a, c, t, g, unknown or other
tactctcgtgcacgaccggtgctcgatttagtctagcgactttgggtttgggctgagcgtggttttccgtcgttaggctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctgggggacacgggctgtgtattactgtgcgagagcggctggcaactacatccattacggtttggacgtctggggccaagggaccacggtcatcgtctccccagcctccaccaagggcccatcggtcttcccctggcgccctgctccagngcaccg

SEQ ID NO: 445785 - DNA, 487 bp, Homo sapiens
  misc_feature: HEFZJCU01BUXHI.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctccaccaagggcccatcggtcttccccctggcaccctcctccaagagcacctctgggggcacagcggccctgggctgcctggtcaaggactacttccgagtagtaca

SEQ ID NO: 445786 - DNA, 314 bp, Homo sapiens; identical to SEQ ID NO: 444774
  misc_feature: HEFZJCU01E2S1G.7.10.A10.1.454.heavy.3.raw

SEQ ID NO: 445787 - DNA, 384 bp, Homo sapiens; identical to SEQ ID NO: 444454
  misc_feature: HEFZJCU01EER1Q.11.61.F06.1.454.heavy.3.raw

SEQ ID NO: 445788 - DNA, 490 bp, Homo sapiens
  misc_feature: HEFZJCU01CJOXF.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactactccgtatctctcg

SEQ ID NO: 445789 - DNA, 371 bp, Homo sapiens; identical to SEQ ID NO: 444435
  misc_feature: HEFZJCU01DGVE8.3.42.D09.1.454.heavy.3.raw

SEQ ID NO: 445790 - DNA, 511 bp, Homo sapiens
  misc_feature: HEFZJCU01CXK7H.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcacctggtcactgtctcctcggcttccaccaagggcccatcggtcttcccctggcgccctgctccaggagcacctctggggcacagcggcccg

SEQ ID NO: 445791 - DNA, 519 bp, Homo sapiens; identical to SEQ ID NO: 445330
  misc_feature: HEFZJCU01DS9MS.7.78.H01.1.454.heavy.3.raw

SEQ ID NO: 445792 - DNA, 396 bp, Homo sapiens; identical to SEQ ID NO: 444426
  misc_feature: HEFZJCU01EBV0L.18.31.C09.1.454.heavy.3.raw

SEQ ID NO: 445793 - DNA, 514 bp, Homo sapiens
  misc_feature: HEFZJCU01CU9JQ.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgt

SEQ ID NO: 445794 - DNA, 518 bp, Homo sapiens; identical to SEQ ID NO: 445423
  misc_feature: HEFZJCU01DCTEQ.7.78.H01.1.454.heavy.3.raw

SEQ ID NO: 445795 - DNA, 501 bp, Homo sapiens
  misc_feature: HEFZJCU01B2G2F.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtccttcccctggcgccctgctccaggagcacctccgagagcacagcggccctgggctgcctggtcaaggactacttcctacgtcgtat

SEQ ID NO: 445796 - DNA, 533 bp, Homo sapiens
  misc_feature: HEFZJCU01DFBAH.8.33.C11.1.454.heavy.3.raw
ctcgcgtgtccacgaccggtgctcgatttagagtgagctcgttgggtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccagggtaccctggtcaccgtctcctcagcctccaccaagggcccatcggtcttcccctggcgccctgctccaggagcacctccgagagcacacg

SEQ ID NO: 445797 - DNA, 396 bp, Homo sapiens; identical to SEQ ID NO: 444469
  misc_feature: HEFZJCU01BRGL1.47.46.E02.1.454.heavy.3.raw

SEQ ID NO: 445798 - DNA, 496 bp, Homo sapiens
  misc_feature: HEFZJCU01AL8K2.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggccctgggctgcctggtcaggactacttcctacgtcgtat

SEQ ID NO: 445799 - DNA, 390 bp, Homo sapiens; identical to SEQ ID NO: 444654
  misc_feature: HEFZJCU01ED8I1.16.17.B06.1.454.heavy.3.raw

SEQ ID NO: 445800 - DNA, 411 bp, Homo sapiens; identical to SEQ ID NO: 445580
  misc_feature: HEFZJCU01B0BE7.51.31.C09.1.454.heavy.3.raw

SEQ ID NO: 445801 - DNA, 509 bp, Homo sapiens
  misc_feature: HEFZJCU01BLR5F.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcacctctggggcacagcggccctgggctgcctggtcaaggactacttcccata

SEQ ID NO: 445802 - DNA, 521 bp, Homo sapiens
  misc_feature: HEFZJCU01ER320.21.86.H09.1.454.heavy.3.raw
tcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggccagggaaccctagtcaccgtctcctcagcctccaccaagggcccatcggtccttcccctggccgccctgctccaggagccacctccgagagcacagcggcccgtgggctgcctggtcaaggactacttcccga

SEQ ID NO: 445803 - DNA, 489 bp, Homo sapiens; identical to SEQ ID NO: 444791
  misc_feature: HEFZJCU01DSXET.47.85.H08.1.454.heavy.3.raw

SEQ ID NO: 445804 - DNA, 502 bp, Homo sapiens
  misc_feature: HEFZJCU01CYZNY.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctg

SEQ ID NO: 445805 - DNA, 488 bp, Homo sapiens
  misc_feature: HEFZJCU01D7M8D.47.85.H08.1.454.heavy.3.raw
  modified_base (486)..(486): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggacgcacctccgagagcacagccggcctgggctgcctgtcaagactacttcctacgtganct

SEQ ID NO: 445806 - DNA, 487 bp, Homo sapiens; identical to SEQ ID NO: 445219
  misc_feature: HEFZJCU01DBB8I.10.85.H08.1.454.heavy.3.raw

SEQ ID NO: 445807 - DNA, 500 bp, Homo sapiens
  misc_feature: HEFZJCU01BMHQC.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccg

SEQ ID NO: 445808 - DNA, 493 bp, Homo sapiens
  misc_feature: HEFZJCU01EWNL5.51.64.F09.1.454.heavy.3.raw
cgatcgtatacacgaccggtgctcgatttagcgcgtatacaagggggctctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacggatgagtgggaactta

SEQ ID NO: 445809 - DNA, 488 bp, Homo sapiens
  misc_feature: HEFZJCU01AM4RP.52.6.A06.1.454.heavy.3.raw
cgcagtacgacacgaccggtgctcgatttagatctactgacaggggtctgggagacgagcccagcactggaagtcgccggtgtttccattcggtgatcatcactgaacacagaggactcaccatggagtttgggcagagctgggttctcctcgttgttcttttaagaggtgtcctgtgcaggctctgcatttcccttcagtaactatgctatcgattgggtccgccaggctccaggcaagggactggagtgggtggcagttatatcagctgatggaggcaataagtattacgcagattctgcgaggggccgattcaccatatccagagacaactcccaagatatgatatatctgcaaatgaacagcctgagacctgaggacacggccatatattattgtgcgtcagggggcagtgcctggccacgtgatgcttttgatttctggggccaagggacattcgtcaccgtctcctcagcctccaccaaggg

SEQ ID NO: 445810 - DNA, 518 bp, Homo sapiens
  misc_feature: HEFZJCU01C0P6O.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttcccctggcaccctcctccaagagcacctctgggggcacagcggccctgggctgcctggtcaaggactacttcctgtcgagcgt

SEQ ID NO: 445811 - DNA, 500 bp, Homo sapiens
  misc_feature: HEFZJCU01CS86Y.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 445812 - DNA, 396 bp, Homo sapiens; identical to SEQ ID NO: 444469
  misc_feature: HEFZJCU01EP62L.47.46.E02.1.454.heavy.3.raw

SEQ ID NO: 445813 - DNA, 515 bp, Homo sapiens
  misc_feature: HEFZJCU01CQOZ7.13.10.A10.1.454.heavy.3.raw
  modified_base (440)..(440): a, c, t, g, unknown or other
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtnttccccctggcaccctcctcccaagacgcacctctgggggcacagcggccctgggctgcctggtcaaggctactt

SEQ ID NO: 445814 - DNA, 396 bp, Homo sapiens
  misc_feature: HEFZJCU01CF6SL.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctaccgtgagct

SEQ ID NO: 445815 - DNA, 505 bp, Homo sapiens; identical to SEQ ID NO: 444927
  misc_feature: HEFZJCU01CHRZW.17.31.C09.1.454.heavy.3.raw

SEQ ID NO: 445816 - DNA, 324 bp, Homo sapiens; identical to SEQ ID NO: 444475
  misc_feature: HEFZJCU01BK0Z4.18.17.B06.1.454.heavy.3.raw

SEQ ID NO: 445817 - DNA, 531 bp, Homo sapiens
  misc_feature: HEFZJCU01EKP15.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccaccaaggg

SEQ ID NO: 445818 - DNA, 396 bp, Homo sapiens
  misc_feature: HEFZJCU01ALZTK.16.68.G02.1.454.heavy.3.raw
tgtactactccacgaccggtgctcgatttagtcgatagtgaagggaaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 445819 - DNA, 427 bp, Homo sapiens; identical to SEQ ID NO: 444708
  misc_feature: HEFZJCU01D53LX.9.34.D01.1.454.heavy.3.raw

SEQ ID NO: 445820 - DNA, 392 bp, Homo sapiens
  misc_feature: HEFZJCU01EMCHK.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctacagcctccaccaagggcccatcggtcttccccctggcgccctgctccaggagcacctccgagagcacagcggccctgggctgcctggtcaaggctacttcctagagacacg

SEQ ID NO: 445821 - DNA, 497 bp, Homo sapiens
  misc_feature: HEFZJCU01CZXK6.22.86.H09.1.454.heavy.3.raw
acatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgctccaggagcacctccgagagcacagcggccctgggctgcctggtcaaggactacttccagacgtatca

SEQ ID NO: 445822 - DNA, 468 bp, Homo sapiens
  misc_feature: HEFZJCU01DBZJP.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 445823 - DNA, 493 bp, Homo sapiens
  misc_feature: HEFZJCU01EAMW2.4.7.A07.1.454.heavy.3.raw
agcactgtagcacgaccggtgctcgatttagcacgtgtcgcaggggctgaggagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 445824 - DNA, 509 bp, Homo sapiens
  misc_feature: HEFZJCU01B86IB.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 445825 - DNA, 449 bp, Homo sapiens
  misc_feature: HEFZJCU01BMHX9.48.73.G07.1.454.heavy.3.raw
agtatacatacacgaccggtgctcgatttagctctacgctcagggcacgaccggtgctcgatttagtgtgagtagttccgcgggcacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 445826 - DNA, 503 bp, Homo sapiens
  misc_feature: HEFZJCU01DJH6K.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacacggcccccggacaagggcttgagtgggtggggtggtcagcggctttgacggtaaggcacagtatgcaccgaagatgaagggcagagtcacgattaccgacggaccacccccacgaacacagtctacatgcaactgacgagcctgagagctgacgacacggccgtctattactgtgcgagaatgttttctgtcatcgtacaatttgataggctctatggactggacttgtc

SEQ ID NO: 445827 - DNA, 484 bp, Homo sapiens
  misc_feature: HEFZJCU01B85UW.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgttcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttcctactatg

SEQ ID NO: 445828 - DNA, 540 bp, Homo sapiens
  misc_feature: HEFZJCU01CJ0R5.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcacccgtctcctcagcctccaccaagggcccatcggtcttcccctggcaccctccctccaagagcacctctgggggcacgagcgccgtgggctgcctggtacg

SEQ ID NO: 445829 - DNA, 524 bp, Homo sapiens
  misc_feature: HEFZJCU01C7W3S.49.25.C03.1.454.heavy.3.raw
agtcgagagacacgaccggtgctcgatttagtagtgtagatttgggtttggggagctctgagagaggagcccagccctgggattttcaggtgttttcatttggtgatcaggactgaacagagagaactcaccatggagtttgggctgagcgtgtcgttttctaggtcggctactttaaaaggtgtccagtgtgacgtccaactggtggagtctggggaggcttggtgcagcctggggggtccctgagactctcctgtgtagcctctgagttcacctttagagtctatgccatgagttgggtccgccaggctccaggggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtataattactgtgtgaaagaagatggaccgctggacgaggagccctaggcgggtt

SEQ ID NO: 445830 - DNA, 509 bp, Homo sapiens
  misc_feature: HEFZJCU01CUW3F.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctgggccaagggaccgcggtcaccgtctcctcagcctccaccaagggcccatcggtcttcccctggccaccctcctccaagagcacctctgggggcacagcggccctgggctgcctggtcaaggactacttcctagta

SEQ ID NO: 445831 - DNA, 525 bp, Homo sapiens
  misc_feature: HEFZJCU01CDCUA.11.25.C03.1.454.heavy.3.raw
cgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 445832 - DNA, 534 bp, Homo sapiens
  misc_feature: HEFZJCU01EYR38.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtcaccg

SEQ ID NO: 445833 - DNA, 500 bp, Homo sapiens; identical to SEQ ID NO: 444864
  misc_feature: HEFZJCU01D1XP7.9.30.C08.1.454.heavy.3.raw

SEQ ID NO: 445834 - DNA, 500 bp, Homo sapiens; identical to SEQ ID NO: 445028
  misc_feature: HEFZJCU01EYIG0.13.12.B01.1.454.heavy.3.raw

SEQ ID NO: 445835 - DNA, 466 bp, Homo sapiens
  misc_feature: HEFZJCU01AELH2.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 445836 - DNA, 385 bp, Homo sapiens; identical to SEQ ID NO: 444438
  misc_feature: HEFZJCU01BLT79.18.60.F05.1.454.heavy.3.raw

SEQ ID NO: 445837 - DNA, 460 bp, Homo sapiens
  misc_feature: HEFZJCU01CN5E8.10.77.G11.1.454.heavy.3.raw
catagtagtgcacgaccggtgctcgatttagctagtcactcaagggaaagggtgtacacctgtggttctcggggctgccctttggctttggagatggttttctcgaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 445838 - DNA, 530 bp, Homo sapiens
  misc_feature: HEFZJCU01DNHF3.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaaccctggtcaccgtctcctcagcctccaccaagggcccatcggtcttcccctggcaccctcctcc

SEQ ID NO: 445839 - DNA, 405 bp, Homo sapiens
  misc_feature: HEFZJCU01EIS9R.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggagcacctctgagagcacagcggccctgggctgcctggtcaaggactacttccgagtgcgtct

SEQ ID NO: 445840 - DNA, 511 bp, Homo sapiens
  misc_feature: HEFZJCU01AHH3F.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctggg

SEQ ID NO: 445841 - DNA, 485 bp, Homo sapiens; identical to SEQ ID NO: 444908
  misc_feature: HEFZJCU01AOL7N.12.40.D07.1.454.heavy.3.raw

SEQ ID NO: 445842 - DNA, 520 bp, Homo sapiens
  misc_feature: HEFZJCU01C885Y.51.70.G04.1.454.heavy.3.raw
cgatcgtatacacgaccggtgctcgatttagtgtagtgtgaagggaaaggggactttctgagactcatggacctcctgcacaagaacaagaaacacctgtggttcttcctcctcctggtggcagctcccagatgggtcctctctcaggtgcagctgcaggagtcgggcccaggactggtgaagccttcggggaccctgtccctcacctgcgctgtctctggtgtctccatccgcagtcctaattggtggagttgggtccgtcagcccccagggaagcggctggagtggattggggaaatctatcatactgagaacaccaactacaacccgtccctcgagagtcgagtcaccatgtcaatagacaagggcaacaatgagttctccctgaatctgcggtctgtgaccgccgcggacacggccgtgtattattgtgtgagagatcggcaagatagtagtggttattacatcggtgactacgacggtatggacgtctggggccaagggaccacggtcatcgtct

SEQ ID NO: 445843 - DNA, 483 bp, Homo sapiens; identical to SEQ ID NO: 444532
  misc_feature: HEFZJCU01C2S7A.47.59.F04.1.454.heavy.3.raw

SEQ ID NO: 445844 - DNA, 438 bp, Homo sapiens; identical to SEQ ID NO: 444944
  misc_feature: HEFZJCU01E1WIE.51.5.A05.1.454.heavy.3.raw

SEQ ID NO: 445845 - DNA, 518 bp, Homo sapiens
  misc_feature: HEFZJCU01BH68E.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaatgaacaccctgcgagccgaggacacggccgtatattactgtgcgagaataacccgttcgcctggttattacc

SEQ ID NO: 445846 - DNA, 483 bp, Homo sapiens; identical to SEQ ID NO: 444924
  misc_feature: HEFZJCU01B18EO.10.35.D02.1.454.heavy.3.raw

SEQ ID NO: 445847 - DNA, 374 bp, Homo sapiens; identical to SEQ ID NO: 444502
  misc_feature: HEFZJCU01EB4P7.9.14.B03.1.454.heavy.3.raw

SEQ ID NO: 445848 - DNA, 379 bp, Homo sapiens
  misc_feature: HEFZJCU01BTTA2.2.86.H09.1.454.heavy.3.raw
acgctcgacacacgaccggtgctcgatttagtgctatagacttgggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 445849 - DNA, 384 bp, Homo sapiens; identical to SEQ ID NO: 444454
  misc_feature: HEFZJCU01BMYLH.11.61.F06.1.454.heavy.3.raw

SEQ ID NO: 445850 - DNA, 371 bp, Homo sapiens; identical to SEQ ID NO: 444435
  misc_feature: HEFZJCU01BVPUG.3.42.D09.1.454.heavy.3.raw

SEQ ID NO: 445851 - DNA, 492 bp, Homo sapiens; identical to SEQ ID NO: 444695
  misc_feature: HEFZJCU01EPQ1V.3.34.D01.1.454.heavy.3.raw

SEQ ID NO: 445852 - DNA, 458 bp, Homo sapiens
  misc_feature: HEFZJCU01DQ8GS.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgcccaagatcgccattccactttgactactggggccagggaacactggtcaccgtctcctcagcctccaccaagggcccatcggtcttccccctggcaccctcctccaagagcacctctgggggcacagcggccctgggctgcctggtcaggactacttcctcgtactgcg

SEQ ID NO: 445853 - DNA, 408 bp, Homo sapiens
  misc_feature: HEFZJCU01D7UAH.49.43.D10.1.454.heavy.3.raw
agtcgagagacacgaccggtgctcgatttagactagcagtaaggggctggagtgggtctctgccattagtggaagtggtgatctcagatactacggagactccgtgaagggccggttcaccatctccagagacaactccaagaatacgctctatctacacatgaaaaacctaagagccgacgacacggccgtctattactgtgcaaagtgggtcatggactacgatgatactagtggctattactccggtgactactttgactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 445854 - DNA, 497 bp, Homo sapiens; identical to SEQ ID NO: 444995
  misc_feature: HEFZJCU01C557D.4.26.C04.1.454.heavy.3.raw

SEQ ID NO: 445855 - DNA, 381 bp, Homo sapiens; identical to SEQ ID NO: 444427
  misc_feature: HEFZJCU01C7FMD.9.53.E09.1.454.heavy.3.raw

SEQ ID NO: 445856 - DNA, 387 bp, Homo sapiens; identical to SEQ ID NO: 445229
  misc_feature: HEFZJCU01D2K0J.11.20.B09.1.454.heavy.3.raw

SEQ ID NO: 445857 - DNA, 478 bp, Homo sapiens
  misc_feature: HEFZJCU01DRQ00.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggccatcggtcttcccctggcacctcctccaagagcacctctggggcacagcggccctgggctgcctggtcaaggactacttcctagagacacg

SEQ ID NO: 445858 - DNA, 506 bp, Homo sapiens
  misc_feature: HEFZJCU01D0FY4.5.24.C02.1.454.heavy.3.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgatttattactgcagctcatatgcaggcagcagcagtccccatgtgatcttcggcggggggaccaagctgaccgtccaggtcagcccaaggctgcccccg

SEQ ID NO: 445859 - DNA, 517 bp, Homo sapiens
  misc_feature: HEFZJCU01CA3A8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggaccg

SEQ ID NO: 445860 - DNA, 482 bp, Homo sapiens; identical to SEQ ID NO: 444503
  misc_feature: HEFZJCU01CT8OT.7.10.A10.1.454.heavy.3.raw

SEQ ID NO: 445861 - DNA, 518 bp, Homo sapiens
  misc_feature: HEFZJCU01DGMIO.4.67.G01.1.454.heavy.3.raw
  modified_base (489)..(489): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctggggaaggggctggagtggatctcagggatttaggtggcactgggcgattatacatattatacagactccgtgaagggccgcttcaccatctccagagacaattccaagaacacggtgtatctgcaaatgaacagcctgagagccgaggacacggccacatattactgtgcgaaagntctcgggctgggtttccgcgggtccgggt

SEQ ID NO: 445862 - DNA, 382 bp, Homo sapiens
  misc_feature: HEFZJCU01CJEZF.21.46.E02.1.454.heavy.3.raw
tcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactactccgagcgacga

SEQ ID NO: 445863 - DNA, 518 bp, Homo sapiens; identical to SEQ ID NO: 444718
  misc_feature: HEFZJCU01EIJFL.9.34.D01.1.454.heavy.3.raw

SEQ ID NO: 445864 - DNA, 506 bp, Homo sapiens
  misc_feature: HEFZJCU01DQSSC.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttcctagtacgtga

SEQ ID NO: 445865 - DNA, 357 bp, Homo sapiens
  misc_feature: HEFZJCU01BBYFU.49.39.D06.1.454.heavy.3.raw
agtcgagagacacgaccggtgctcgatttagtgacatctcgcagttctttgggtagtaatcgttgcctgccgcacagtaatacacagccgagtcaccacctccagacacaattcccccaagaacacggtgtttctgctggtgaacagcctgagaactgaggacacggctgtgtattactgtgcggcaggcaacgattactacccgaaggaatactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 445866 - DNA, 533 bp, Homo sapiens
  misc_feature: HEFZJCU01EJ3PQ.14.57.F02.1.454.heavy.3.raw
  modified_base (385)..(385): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgatacccaatttgggaggggcctttcatgtctggggccaagggacgctggtcaccgtctcttcagcctccaccaaggccatcggtcttccctggcaccctcctccaagagcacctctggggcacagcc

SEQ ID NO: 445867 - DNA, 501 bp, Homo sapiens
  misc_feature: HEFZJCU01CNZG0.51.43.D10.1.454.heavy.3.raw
cgatcgtatacacgaccggtgctcgatttagactagcagtaaggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaactactt

SEQ ID NO: 445868 - DNA, 505 bp, Homo sapiens; identical to SEQ ID NO: 445664
  misc_feature: HEFZJCU01A0PPB.12.33.C11.1.454.heavy.3.raw

SEQ ID NO: 445869 - DNA, 527 bp, Homo sapiens
  misc_feature: HEFZJCU01AMCX0.51.85.H08.1.454.heavy.3.raw
cgatcgtatacacgaccggtgctcgatttagtatcactcagtcgcgggtcggggggaggcgtggtccagcctggggggtccctgagagtctcgtgtgcagcctctggattcaccttcaggcgttacggcatgaactgggtccgccaggctccaggcaaggggctggagtgggtggctgtcataacatttgatggaactaagaaatattatgcagactccgtgaagggccgattcaccatctccagagacaattcaaaggacaccctatatttagaaatgagcagcctgagacctgcggacacggctgtgtattactgtgcgaaagatgggggaagttatttctatgatagtgttgggcgttactactcgaacgagtttgactactggggccagggagccctggtcaccgtctcctcagcctccaccaagggcccatcggtcttccccctggcaccctcctccaagagcaccctctgggggcacagcggccctggctgcctggtcaaggactacttcctcgtagcact

SEQ ID NO: 445870 - DNA, 408 bp, Homo sapiens
  misc_feature: HEFZJCU01BEBIX.49.73.G07.1.454.heavy.3.raw
agtcgagagacacgaccggtgctcgatttagctctacgctcagggcacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 445871 - DNA, 511 bp, Homo sapiens
  misc_feature: HEFZJCU01C7QFD.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctgggggcacagcggccctgggctgcctggtcaaggactacttccgtactacg

SEQ ID NO: 445872 - DNA, 492 bp, Homo sapiens; identical to SEQ ID NO: 444827
  misc_feature: HEFZJCU01BVS0M.4.28.C06.1.454.heavy.3.raw

SEQ ID NO: 445873 - DNA, 324 bp, Homo sapiens; identical to SEQ ID NO: 444475
  misc_feature: HEFZJCU01CYHWN.18.17.B06.1.454.heavy.3.raw

SEQ ID NO: 445874 - DNA, 400 bp, Homo sapiens; identical to SEQ ID NO: 444452
  misc_feature: HEFZJCU01BIWF1.47.24.C02.1.454.heavy.3.raw

SEQ ID NO: 445875 - DNA, 482 bp, Homo sapiens; identical to SEQ ID NO: 444503
  misc_feature: HEFZJCU01EYCOS.7.10.A10.1.454.heavy.3.raw

SEQ ID NO: 445876 - DNA, 484 bp, Homo sapiens
  misc_feature: HEFZJCU01ET01P.8.39.D06.1.454.heavy.3.raw
ctcgcgtgtccacgaccggtgctcgatttagtgacatctcgcagttctttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctac

SEQ ID NO: 445877 - DNA, 324 bp, Homo sapiens; identical to SEQ ID NO: 444475
  misc_feature: HEFZJCU01DKYDF.18.17.B06.1.454.heavy.3.raw

SEQ ID NO: 445878 - DNA, 356 bp, Homo sapiens; identical to SEQ ID NO: 444460
  misc_feature: HEFZJCU01CIWA0.47.38.D05.1.454.heavy.3.raw

SEQ ID NO: 445879 - DNA, 492 bp, Homo sapiens
  misc_feature: HEFZJCU01B62C5.4.21.B10.1.454.heavy.3.raw
agcactgtagcacgaccggtgctcgatttagtgtcgtcgcaagagagggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttcctacagtgct

SEQ ID NO: 445880 - DNA, 383 bp, Homo sapiens
  misc_feature: HEFZJCU01AQZAW.22.46.E02.1.454.heavy.3.raw
acatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccagacgtatca

SEQ ID NO: 445881 - DNA, 504 bp, Homo sapiens; identical to SEQ ID NO: 445353
  misc_feature: HEFZJCU01CL2PL.10.38.D05.1.454.heavy.3.raw

SEQ ID NO: 445882 - DNA, 409 bp, Homo sapiens; identical to SEQ ID NO: 444519
  misc_feature: HEFZJCU01DLWDU.3.41.D08.1.454.heavy.3.raw

SEQ ID NO: 445883 - DNA, 490 bp, Homo sapiens
  misc_feature: HEFZJCU01ESAA0.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccatcggtcttcccctggcgcctgctccaggagcacctccgagagcacagcggccctgggctgcctggtcaaggactacttccctacagtgct

SEQ ID NO: 445884 - DNA, 370 bp, Homo sapiens
  misc_feature: HEFZJCU01EGOBM.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctggggcacagcggccctgggctgcctggtcaaggactacttccgagtgcgtct

SEQ ID NO: 445885 - DNA, 445 bp, Homo sapiens
  misc_feature: HEFZJCU01DADD4.48.41.D08.1.454.heavy.3.raw
agtatacatacacgaccggtgctcgatttagtcacgcgagaaagggaaaggggactagaaggggaactggtcttaattgcttgatgaagagcaggagactcatttatgtgagtcttttgagtgaccattgtctgggtcactcccatttaactttccctaaagcccatttgaaggagaggtcgcacgagctgctccacaacctctgaatggggatggcatgggtaatgatgcttgagaacataccaagccccactggcatcgcccttgtctaagtcattgactgtaggtcatcatcgcacccttgaaagtagcccatgccttccaaagcgatttatgcctccaccaagggcccatcggtcttccccctggcaccctcctccaagagcacctctgggggcacagcggccctgggctgcctggtcaaggactatttcctatgtatact

SEQ ID NO: 445886 - DNA, 519 bp, Homo sapiens
  misc_feature: HEFZJCU01C871E.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattta

SEQ ID NO: 445887 - DNA, 459 bp, Homo sapiens
  misc_feature: HEFZJCU01AQT2B.15.28.C06.1.454.heavy.3.raw
tctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccaggagcacctccgagagcacagcggccctgggctgcctggtcaaggactacttccgctacgtaga

SEQ ID NO: 445888 - DNA, 432 bp, Homo sapiens; identical to SEQ ID NO: 444920
  misc_feature: HEFZJCU01EMAQS.11.39.D06.1.454.heavy.3.raw

SEQ ID NO: 445889 - DNA, 524 bp, Homo sapiens
  misc_feature: HEFZJCU01CTB3Q.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctcccaccctccaccaagggcccatcggtcttcccctggcaccctcctccaagagcacctctgggggcacagcggccctgggctgcctggtcaaggactacttcccatactcgta

SEQ ID NO: 445890 - DNA, 508 bp, Homo sapiens
  misc_feature: HEFZJCU01BBCEY.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggatttgatttccg

SEQ ID NO: 445891 - DNA, 497 bp, Homo sapiens; identical to SEQ ID NO: 445179
  misc_feature: HEFZJCU01ED578.12.55.E11.1.454.heavy.3.raw

SEQ ID NO: 445892 - DNA, 517 bp, Homo sapiens
  misc_feature: HEFZJCU01A64OA.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctcaccaagggcccatcggtcttcccctggcaccctcctccaagagcacctctgggggcacagcggccctgggctgcctggtcaaggactacttccagacgtatca

SEQ ID NO: 445893 - DNA, 387 bp, Homo sapiens
  misc_feature: HEFZJCU01CPKEF.9.53.E09.1.454.heavy.3.raw
tgatacgtctcacgaccggtgctcgatttagagagagtgtgttgggtttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 445894 - DNA, 415 bp, Homo sapiens; identical to SEQ ID NO: 444794
  misc_feature: HEFZJCU01B0P41.14.74.G08.1.454.heavy.3.raw

SEQ ID NO: 445895 - DNA, 400 bp, Homo sapiens; identical to SEQ ID NO: 444452
  misc_feature: HEFZJCU01C747K.47.24.C02.1.454.heavy.3.raw

SEQ ID NO: 445896 - DNA, 490 bp, Homo sapiens
  misc_feature: HEFZJCU01CN29C.49.27.C05.1.454.heavy.3.raw
agtcgagagacacgaccggtgctcgatttagacgcgatcgaagggtttggggggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttatacg

SEQ ID NO: 445897 - DNA, 535 bp, Homo sapiens
  misc_feature: HEFZJCU01C3CFV.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagcgaagacacgggcgtgtatttttgtgtgaaagatacgaagtctatgatacccaatttgggagggcctttcatgtctggggccaagggacgctggtcaccgtctcttcagcctccaccaagggcccatcggtcttcccctggcaccctcctccaagagcacctctgggggcacagcc

SEQ ID NO: 445898 - DNA, 396 bp, Homo sapiens
  misc_feature: HEFZJCU01DMEZ9.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 445899 - DNA, 491 bp, Homo sapiens
  misc_feature: HEFZJCU01BUBNB.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaggactacttccgtatctctcg

SEQ ID NO: 445900 - DNA, 511 bp, Homo sapiens
  misc_feature: HEFZJCU01EQV68.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcgttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 445901 - DNA, 396 bp, Homo sapiens; identical to SEQ ID NO: 444469
  misc_feature: HEFZJCU01DG8RF.47.46.E02.1.454.heavy.3.raw

SEQ ID NO: 445902 - DNA, 524 bp, Homo sapiens
  misc_feature: HEFZJCU01C0QL6.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 445903 - DNA, 491 bp, Homo sapiens; identical to SEQ ID NO: 445531
  misc_feature: HEFZJCU01ATFNW.11.38.D05.1.454.heavy.3.raw

SEQ ID NO: 445904 - DNA, 536 bp, Homo sapiens
  misc_feature: HEFZJCU01CC25N.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctgggccaagggacgctggtcaccgtctcttcagcctccaccaagggcccatcggtcttcccctggcaccctcctccaagagcacctctgggggcacagcc

SEQ ID NO: 445905 - DNA, 469 bp, Homo sapiens; identical to SEQ ID NO: 445536
  misc_feature: HEFZJCU01DQYU9.48.51.E07.1.454.heavy.3.raw

SEQ ID NO: 445906 - DNA, 527 bp, Homo sapiens
  misc_feature: HEFZJCU01CJ63S.10.38.D05.1.454.heavy.3.raw
  modified_base (310)..(310): a, c, t, g, unknown or other
catagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctganagtcgacgacacggccacctattattgtgcgcgacatgactacgctcaattctggggccagggagcccaggtcaccgtctccccagcctccaccaagggcccatcggtcttccccctggcgccctgctccaggagcgaccctcccggagagcgacacggcggcccctcggggccgttgccctcggttacaacggacgtaaccttccctacctacctt

SEQ ID NO: 445907 - DNA, 395 bp, Homo sapiens
  misc_feature: HEFZJCU01BP21F.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 445908 - DNA, 380 bp, Homo sapiens
  misc_feature: HEFZJCU01DSP0P.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtccttccccctggcgccctgctccaggagcacctcgtggggcacagcggccctgggctgcctggtcaaggactacttcctacgtgagct

SEQ ID NO: 445909 - DNA, 506 bp, Homo sapiens
  misc_feature: HEFZJCU01DLX8W.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaaggccatcggtcttcccctggcaccctctccaagagcacctctggggcacagcggcctgggctgcctggtcaaggactacttccgtactacg

SEQ ID NO: 445910 - DNA, 418 bp, Homo sapiens
  misc_feature: HEFZJCU01B0G57.11.62.F07.1.454.heavy.3.raw
cgagagataccacgaccggtgctcgatttagtagtcgcataaagggaaaggggctgcagtgggtctcaggcattggtaccagtgatgataagacacactacgcagactccgtgaagggccggttcaacatctccagagacaattccaagaacagcctatatctccaaatgaacagcctgagagccgaggacacggccgtctatttctgtgcgaaacacggctgtagtggaggtgactgctactccacggatttctactactacggcatggacctctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 445911 - DNA, 508 bp, Homo sapiens
  misc_feature: HEFZJCU01BRVIW.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaggactacttcctacgtcgtat

SEQ ID NO: 445912 - DNA, 379 bp, Homo sapiens
  misc_feature: HEFZJCU01BY1KK.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcaccctcctccaagagcacctctgggggcacagcggccctgggctgcctggtcaaggactacttcctacgtgagct

SEQ ID NO: 445913 - DNA, 517 bp, Homo sapiens
  misc_feature: HEFZJCU01DZQLB.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctggctgcctggtcaaggactacttcctagagacacg

SEQ ID NO: 445914 - DNA, 396 bp, Homo sapiens; identical to SEQ ID NO: 444469
  misc_feature: HEFZJCU01A3ND1.47.46.E02.1.454.heavy.3.raw

SEQ ID NO: 445915 - DNA, 524 bp, Homo sapiens; identical to SEQ ID NO: 445902
  misc_feature: HEFZJCU01DB1PN.9.78.H01.1.454.heavy.3.raw

SEQ ID NO: 445916 - DNA, 465 bp, Homo sapiens; identical to SEQ ID NO: 444805
  misc_feature: HEFZJCU01D88A5.19.10.A10.1.454.heavy.3.raw

SEQ ID NO: 445917 - DNA, 511 bp, Homo sapiens
  misc_feature: HEFZJCU01CNZLN.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccaggagcacctctggggcacagcggccg

SEQ ID NO: 445918 - DNA, 373 bp, Homo sapiens
  misc_feature: HEFZJCU01DK6ZV.49.30.C08.1.454.heavy.3.raw
agtcgagagacacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 445919 - DNA, 492 bp, Homo sapiens
  misc_feature: HEFZJCU01CNTDR.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgt

SEQ ID NO: 445920 - DNA, 488 bp, Homo sapiens; identical to SEQ ID NO: 444651
  misc_feature: HEFZJCU01CZ7VR.16.67.G01.1.454.heavy.3.raw

SEQ ID NO: 445921 - DNA, 465 bp, Homo sapiens
  misc_feature: HEFZJCU01B46UQ.48.34.D01.1.454.heavy.3.raw
agtatacatacacgaccggtgctcgatttagatcgtctgtgttgggtttggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 445922 - DNA, 514 bp, Homo sapiens
  misc_feature: HEFZJCU01EK7FI.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagagcacctctgggggcacagcggccctgggctgcctgtcgacgacgtacttccgtacctacg

SEQ ID NO: 445923 - DNA, 396 bp, Homo sapiens; identical to SEQ ID NO: 444426
  misc_feature: HEFZJCU01B7BNE.18.31.C09.1.454.heavy.3.raw

SEQ ID NO: 445924 - DNA, 504 bp, Homo sapiens
  misc_feature: HEFZJCU01A5HVS.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggcctgggctgcctggtcaaggactactccgt

SEQ ID NO: 445925 - DNA, 390 bp, Homo sapiens; identical to SEQ ID NO: 444654
  misc_feature: HEFZJCU01C4W68.16.17.B06.1.454.heavy.3.raw

SEQ ID NO: 445926 - DNA, 389 bp, Homo sapiens
  misc_feature: HEFZJCU01D1MEM.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcacgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactactccgagtagtaca

SEQ ID NO: 445927 - DNA, 373 bp, Homo sapiens
  misc_feature: HEFZJCU01AYV6W.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacactggtgtatattactgtgcgagccccggcgcttttgggcggaattcgggactgtggggccagggaaccctggtcagcgtctcagcctccaccaagggcccatcggtcttcccctggcgccctgctccaggagcacctccgagagcacagcggccctgggctgcctggtcaaggactacttcctagagacacg

SEQ ID NO: 445928 - DNA, 506 bp, Homo sapiens; identical to SEQ ID NO: 444696
  misc_feature: HEFZJCU01D8PIX.16.34.D01.1.454.heavy.3.raw

SEQ ID NO: 445929 - DNA, 508 bp, Homo sapiens; identical to SEQ ID NO: 445594
  misc_feature: HEFZJCU01C9CCV.17.25.C03.1.454.heavy.3.raw

SEQ ID NO: 445930 - DNA, 496 bp, Homo sapiens; identical to SEQ ID NO: 444697
  misc_feature: HEFZJCU01BZ771.16.37.D04.1.454.heavy.3.raw

SEQ ID NO: 445931 - DNA, 426 bp, Homo sapiens
  misc_feature: HEFZJCU01EL1DT.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccccggcaccctcctccaagagcacctctgggggcacagcggccctgggctgcctggtcaaggactacttccagacgtatca

SEQ ID NO: 445932 - DNA, 504 bp, Homo sapiens
  misc_feature: HEFZJCU01EDO19.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctacggcagcggcctttgacttctc

SEQ ID NO: 445933 - DNA, 313 bp, Homo sapiens; identical to SEQ ID NO: 444447
  misc_feature: HEFZJCU01AXLHE.7.10.A10.1.454.heavy.3.raw

SEQ ID NO: 445934 - DNA, 396 bp, Homo sapiens; identical to SEQ ID NO: 444469
  misc_feature: HEFZJCU01BUQPJ.47.46.E02.1.454.heavy.3.raw

SEQ ID NO: 445935 - DNA, 517 bp, Homo sapiens
  misc_feature: HEFZJCU01C5N1O.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctggagcgtggacgtttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcacccatactactttgactactggggccaac

SEQ ID NO: 445936 - DNA, 496 bp, Homo sapiens; identical to SEQ ID NO: 444697
  misc_feature: HEFZJCU01DPZH5.16.37.D04.1.454.heavy.3.raw

SEQ ID NO: 445937 - DNA, 509 bp, Homo sapiens
  misc_feature: HEFZJCU01ED471.13.71.G05.1.454.heavy.3.raw
tcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactacg

SEQ ID NO: 445938 - DNA, 379 bp, Homo sapiens; identical to SEQ ID NO: 444450
  misc_feature: HEFZJCU01BZ73V.47.77.G11.1.454.heavy.3.raw

SEQ ID NO: 445939 - DNA, 530 bp, Homo sapiens
  misc_feature: HEFZJCU01AQSQM.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctgggggcacagcggccctgggctgcct

SEQ ID NO: 445940 - DNA, 520 bp, Homo sapiens
  misc_feature: HEFZJCU01EIWQQ.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacac

SEQ ID NO: 445941 - DNA, 507 bp, Homo sapiens
  misc_feature: HEFZJCU01EZEF2.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccgaccttggcttcg

SEQ ID NO: 445942 - DNA, 524 bp, Homo sapiens; identical to SEQ ID NO: 445889
  misc_feature: HEFZJCU01APBM3.18.33.C11.1.454.heavy.3.raw

SEQ ID NO: 445943 - DNA, 396 bp, Homo sapiens; identical to SEQ ID NO: 444469
  misc_feature: HEFZJCU01A6JA1.47.46.E02.1.454.heavy.3.raw

SEQ ID NO: 445944 - DNA, 514 bp, Homo sapiens
  misc_feature: HEFZJCU01A2H35.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccagagcacctctgggggcacagcggcccg

SEQ ID NO: 445945 - DNA, 316 bp, Homo sapiens; identical to SEQ ID NO: 444479
  misc_feature: HEFZJCU01C788P.47.84.H07.1.454.heavy.3.raw

SEQ ID NO: 445946 - DNA, 430 bp, Homo sapiens; identical to SEQ ID NO: 444675
  misc_feature: HEFZJCU01C1GU1.40.34.D01.1.454.heavy.3.raw

SEQ ID NO: 445947 - DNA, 492 bp, Homo sapiens
  misc_feature: HEFZJCU01DAJF3.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggccaccctcctccaagagcacctctgggggcacagcggccctgggctgcctggtcaaggactacttccgagtgcgtct

SEQ ID NO: 445948 - DNA, 400 bp, Homo sapiens; identical to SEQ ID NO: 444452
  misc_feature: HEFZJCU01CY09A.47.24.C02.1.454.heavy.3.raw

SEQ ID NO: 445949 - DNA, 384 bp, Homo sapiens; identical to SEQ ID NO: 444492
  misc_feature: HEFZJCU01BR725.18.60.F05.1.454.heavy.3.raw

SEQ ID NO: 445950 - DNA, 392 bp, Homo sapiens
  misc_feature: HEFZJCU01D026U.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtatattactgtgtgagaggcgccaccgtggggatggaaacgattttcttgtttgtctggggccagggaaccctggtcaccgtctcctcagcctccaccaagggcccatcggtcttccccctggcgccctgctccaggagcacctccgagagcacagtggccctgggctgcctggtcaaggactacttcctagagacacg

SEQ ID NO: 445951 - DNA, 525 bp, Homo sapiens
  misc_feature: HEFZJCU01CNTHE.49.57.F02.1.454.heavy.3.raw
agtcgagagacacgaccggtgctcgatttagctcgatatagttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcc

SEQ ID NO: 445952 - DNA, 498 bp, Homo sapiens
  misc_feature: HEFZJCU01CCD2P.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactacgggggcgttcg

SEQ ID NO: 445953 - DNA, 482 bp, Homo sapiens; identical to SEQ ID NO: 444503
  misc_feature: HEFZJCU01CBKAJ.7.10.A10.1.454.heavy.3.raw

SEQ ID NO: 445954 - DNA, 398 bp, Homo sapiens
  misc_feature: HEFZJCU01ATI0A.18.61.F06.1.454.heavy.3.raw
tacgagtatgcacgaccggtgctcgatttagctacgctctaagggaaaggggctggagtggttgagttttatatcatagtgatggaggttacaaatacttatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagagcacagcggccctgggctgcctggtcaaggactacttcccatactcgta

SEQ ID NO: 445955 - DNA, 536 bp, Homo sapiens
  misc_feature: HEFZJCU01EFMXQ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcacctcctccaagagcacctctgggggcacagcc

SEQ ID NO: 445956 - DNA, 509 bp, Homo sapiens
  misc_feature: HEFZJCU01C04MQ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcacctggtcaccgtctcctcagcttccaccaagggcccatcggtcttcccctggcgccctgctccaggagcacctctgggggcacagcggccctgggctgcctggtcaaggactacttcccata

SEQ ID NO: 445957 - DNA, 523 bp, Homo sapiens
  misc_feature: HEFZJCU01EAMWK.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggcctgggctgcctggtcaaggactacttcc

SEQ ID NO: 445958 - DNA, 384 bp, Homo sapiens; identical to SEQ ID NO: 444454
  misc_feature: HEFZJCU01DMB2T.11.61.F06.1.454.heavy.3.raw

SEQ ID NO: 445959 - DNA, 515 bp, Homo sapiens
  misc_feature: HEFZJCU01ANGPB.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctggcgccctgctccaggagcaccc

SEQ ID NO: 445960 - DNA, 394 bp, Homo sapiens
  misc_feature: HEFZJCU01DU6WI.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggggtgtcccccagaaagggctggttacatgtttgactcctggggccagggaatcctggtcaccgtctcctcagcctccaccaaggcccatcggtcttccccctggcgccctgctccaggagcacctccgagagcacagcggccctgggctgcctggtcaaggactacttcccactactatg

SEQ ID NO: 445961 - DNA, 391 bp, Homo sapiens; identical to SEQ ID NO: 444614
  misc_feature: HEFZJCU01D7DEN.16.70.G04.1.454.heavy.3.raw

SEQ ID NO: 445962 - DNA, 406 bp, Homo sapiens
  misc_feature: HEFZJCU01ALFXB.49.27.C05.1.454.heavy.3.raw
agtcgagagacacgaccggtgctcgatttagacgcgatcgaagggtttgggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 445963 - DNA, 516 bp, Homo sapiens
  misc_feature: HEFZJCU01A8S3G.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctatttaaaaggtgccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagaaaattccaagaacacgctgtttcttcaaatgaacagcctgagagccgatgacacggccgtgtattactgtgcgagagatggggcccacgaacgttactacgctatggacgtctggggccaagggaccac

SEQ ID NO: 445964 - DNA, 372 bp, Homo sapiens; identical to SEQ ID NO: 444727
  misc_feature: HEFZJCU01DVJDI.3.42.D09.1.454.heavy.3.raw

SEQ ID NO: 445965 - DNA, 507 bp, Homo sapiens
  misc_feature: HEFZJCU01CJCJH.40.61.F06.1.454.heavy.3.raw
tctagcgactcacgaccggtgctcgatttagctacgctctaagggaaaggggagctctgggagaggagccccagccctgagattcccatgtgtttccattcagtgatcagcactgcacacagaggactcgccatggagtttgggctgagctgggttttccttgttgctattttaaaaggtgtccagtgtgaagtgcacctggtggaatgggtctctgctattaattggaatggcggtagtggacattatgcagactctgtgaggggccgtttcaccatctccagagacaacgccaagaactccctgtatctgcaaatgaacagtctgaaagtcgaggacacggccttctattactgtgtgagagatgggatgtggcacctgtccctccacacaaattggggccagggaaccctggtcaccgtctcctcagcctccaccaagggcccatcggtcttcccctggcaccctcctccagagcacctctgggggcacagcggccctgggctg

SEQ ID NO: 445966 - DNA, 518 bp, Homo sapiens; identical to SEQ ID NO: 444718
  misc_feature: HEFZJCU01B0P5Y.9.34.D01.1.454.heavy.3.raw

SEQ ID NO: 445967 - DNA, 500 bp, Homo sapiens; identical to SEQ ID NO: 444529
  misc_feature: HEFZJCU01BSW3O.12.38.D05.1.454.heavy.3.raw

SEQ ID NO: 445968 - DNA, 436 bp, Homo sapiens; identical to SEQ ID NO: 444686
  misc_feature: HEFZJCU01EQBX6.40.27.C05.1.454.heavy.3.raw

SEQ ID NO: 445969 - DNA, 373 bp, Homo sapiens
  misc_feature: HEFZJCU01D5DWN.49.58.F03.1.454.heavy.3.raw
agtcgagagacacgaccggtgctcgatttagtctgatcgagaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 445970 - DNA, 432 bp, Homo sapiens
  misc_feature: HEFZJCU01CX5QM.53.65.F10.1.454.heavy.3.raw
cgcgtatacacacgaccggtgctcgatttagctacgctctaagggagtagagtcctgaggactgtaggctcccgggaaggggctggagtgggtctcaggtattagtggcagtggtggaatcacatactacgcagactccgtgaagggccggttcaccatctccagagacaactccaagaacacactgtttctacaaatgaatagcctgagagccgcggacacggccgtatattattgtgcgaaagtttgggggtggcaattggagtggtttttagatccgattgactactggggcctgggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 445971 - DNA, 513 bp, Homo sapiens
  misc_feature: HEFZJCU01BMXJP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcacccatactactttgaactactgggggccc

SEQ ID NO: 445972 - DNA, 387 bp, Homo sapiens; identical to SEQ ID NO: 445170
  misc_feature: HEFZJCU01DPEAE.27.46.E02.1.454.heavy.3.raw

SEQ ID NO: 445973 - DNA, 517 bp, Homo sapiens
  misc_feature: HEFZJCU01EJ396.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactactcctagagacacg

SEQ ID NO: 445974 - DNA, 528 bp, Homo sapiens
  misc_feature: HEFZJCU01ELIO7.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctgggggcacagcggccctgggctg

SEQ ID NO: 445975 - DNA, 494 bp, Homo sapiens
  misc_feature: HEFZJCU01EDL9P.48.70.G04.1.454.heavy.3.raw
agtatacatacacgaccggtgctcgatttagtgtagtgtgaagggaaaggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 445976 - DNA, 399 bp, Homo sapiens
  misc_feature: HEFZJCU01DMNI1.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggctacttcctacgtgagct

SEQ ID NO: 445977 - DNA, 489 bp, Homo sapiens; identical to SEQ ID NO: 444591
  misc_feature: HEFZJCU01DUJ48.18.70.G04.1.454.heavy.3.raw

SEQ ID NO: 445978 - DNA, 519 bp, Homo sapiens; identical to SEQ ID NO: 444867
  misc_feature: HEFZJCU01B73QA.9.34.D01.1.454.heavy.3.raw

SEQ ID NO: 445979 - DNA, 490 bp, Homo sapiens; identical to SEQ ID NO: 444500
  misc_feature: HEFZJCU01DBH29.19.53.E09.1.454.heavy.3.raw

SEQ ID NO: 445980 - DNA, 487 bp, Homo sapiens
  misc_feature: HEFZJCU01ETXXA.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctgcgccctgctccaggagcacctccgagagcacagcggccctgggctgcctggtcaaggctacttcccatactcgta

SEQ ID NO: 445981 - DNA, 499 bp, Homo sapiens; identical to SEQ ID NO: 444610
  misc_feature: HEFZJCU01EKZL9.15.70.G04.1.454.heavy.3.raw

SEQ ID NO: 445982 - DNA, 501 bp, Homo sapiens; identical to SEQ ID NO: 445027
  misc_feature: HEFZJCU01B7K3H.26.23.C01.1.454.heavy.3.raw

SEQ ID NO: 445983 - DNA, 339 bp, Homo sapiens; identical to SEQ ID NO: 444436
  misc_feature: HEFZJCU01AL3JX.47.38.D05.1.454.heavy.3.raw

SEQ ID NO: 445984 - DNA, 378 bp, Homo sapiens; identical to SEQ ID NO: 444419
  misc_feature: HEFZJCU01C3U8J.47.77.G11.1.454.heavy.3.raw

SEQ ID NO: 445985 - DNA, 391 bp, Homo sapiens
  misc_feature: HEFZJCU01B9YTF.49.46.E02.1.454.heavy.3.raw
agtcgagagacacgaccggtgctcgatttagactcatctacagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcatcctccaccaagggcccatcggtcttccccctggcaccctcctccaagagcacctctgggggcacagcggccctgggctgcctggtcaaggactacttcctctctcga

SEQ ID NO: 445986 - DNA, 518 bp, Homo sapiens
  misc_feature: HEFZJCU01DWSC4.52.78.H01.1.454.heavy.3.raw
cgcagtacgacacgaccggtgctcgatttagtgtgagtagtttgggtttgggggagggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacg

SEQ ID NO: 445987 - DNA, 315 bp, Homo sapiens; identical to SEQ ID NO: 444422
  misc_feature: HEFZJCU01CK2T3.47.84.H07.1.454.heavy.3.raw

SEQ ID NO: 445988 - DNA, 477 bp, Homo sapiens
  misc_feature: HEFZJCU01COBQF.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagcgtggtttcgtcgtaggctctttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagaga

SEQ ID NO: 445989 - DNA, 336 bp, Homo sapiens; identical to SEQ ID NO: 444510
  misc_feature: HEFZJCU01ECDNR.3.31.C09.1.454.heavy.3.raw

SEQ ID NO: 445990 - DNA, 503 bp, Homo sapiens; identical to SEQ ID NO: 444557
  misc_feature: HEFZJCU01BGSFB.9.33.C11.1.454.heavy.3.raw

SEQ ID NO: 445991 - DNA, 359 bp, Homo sapiens
  misc_feature: HEFZJCU01DKGCZ.14.39.D06.1.454.heavy.3.raw
cgtctagtaccacgaccggtgctcgatttagtgacatctcgcagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 445992 - DNA, 513 bp, Homo sapiens
  misc_feature: HEFZJCU01EJUC8.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgaccctggggccagggaacccttgtcaccgtctcctcagcctcaccaaggccc

SEQ ID NO: 445993 - DNA, 502 bp, Homo sapiens
  misc_feature: HEFZJCU01BUX4P.48.23.C01.1.454.heavy.3.raw
  modified_base (474)..(474): a, c, t, g, unknown or other
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgntatgtgggccaagggacaatggtcacgt

SEQ ID NO: 445994 - DNA, 513 bp, Homo sapiens; identical to SEQ ID NO: 445134
  misc_feature: HEFZJCU01EBWWV.3.34.D01.1.454.heavy.3.raw

SEQ ID NO: 445995 - DNA, 503 bp, Homo sapiens
  misc_feature: HEFZJCU01C1RLK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctc

SEQ ID NO: 445996 - DNA, 518 bp, Homo sapiens
  misc_feature: HEFZJCU01CYSYF.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaaccctggtcgccgtctcctcagcctccaccaagggcccatcggtcttcccctggcgccctgctccaggagcacctccgagagcacagcggccctgggctgcctggtcaaggactacttccagacgtatcac

SEQ ID NO: 445997 - DNA, 375 bp, Homo sapiens
  misc_feature: HEFZJCU01EAJTO.40.86.H09.1.454.heavy.3.raw
tctagcgactcacgaccggtgctcgatttagtgctatagacttgggccttgagtggctggggaggacatactacaggtccacgtggaaaacgattatgcagcatctgtgaaaagtcgaataaccatcgacccagacacatccaagaaccagttctccctgcaactgaactctctgactcccgaagacacggctgtctattactgtgcatatggttcggggagttatccctattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 445998 - DNA, 510 bp, Homo sapiens
  misc_feature: HEFZJCU01CS6K9.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttagtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 445999 - DNA, 501 bp, Homo sapiens
  misc_feature: HEFZJCU01AG8VY.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccctggcgccctgctccaggagcacctccgagagcacagcggccctgggctgcctggtcaaggactacttcctacgtcgtat

SEQ ID NO: 446000 - DNA, 507 bp, Homo sapiens; identical to SEQ ID NO: 445781
  misc_feature: HEFZJCU01B9BTQ.48.44.D11.1.454.heavy.3.raw

SEQ ID NO: 446001 - DNA, 387 bp, Homo sapiens; identical to SEQ ID NO: 445229
  misc_feature: HEFZJCU01EZVH8.11.20.B09.1.454.heavy.3.raw

SEQ ID NO: 446002 - DNA, 508 bp, Homo sapiens
  misc_feature: HEFZJCU01B9FSG.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 446003 - DNA, 396 bp, Homo sapiens; identical to SEQ ID NO: 444469
  misc_feature: HEFZJCU01CMXFZ.47.46.E02.1.454.heavy.3.raw

SEQ ID NO: 446004 - DNA, 501 bp, Homo sapiens; identical to SEQ ID NO: 445341
  misc_feature: HEFZJCU01DVINZ.48.34.D01.1.454.heavy.3.raw

SEQ ID NO: 446005 - DNA, 389 bp, Homo sapiens
  misc_feature: HEFZJCU01DGWY4.48.70.G04.1.454.heavy.3.raw
agtatacatacacgaccggtgctcgatttagtgtagtgtgaagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 446006 - DNA, 517 bp, Homo sapiens; identical to SEQ ID NO: 444897
  misc_feature: HEFZJCU01A65JV.9.34.D01.1.454.heavy.3.raw

SEQ ID NO: 446007 - DNA, 379 bp, Homo sapiens; identical to SEQ ID NO: 444450
  misc_feature: HEFZJCU01DV8VX.47.77.G11.1.454.heavy.3.raw

SEQ ID NO: 446008 - DNA, 410 bp, Homo sapiens
  misc_feature: HEFZJCU01DY4EX.19.12.B01.1.454.heavy.3.raw
tactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 446009 - DNA, 532 bp, Homo sapiens
  misc_feature: HEFZJCU01AEUSI.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggcaccctcctccaagagcacctctc

SEQ ID NO: 446010 - DNA, 337 bp, Homo sapiens
  misc_feature: HEFZJCU01DM3T3.51.30.C08.1.454.heavy.3.raw
cgatcgtatacacgaccggtgctcgatttagtctgacgtcaaagggaaagggccgattcaccatctccagagacaattccaagaatacactatatcttcaaatgaacagtctgagacgtgaagacacggctgtctattactgtgcgactgagatgtcttattacgatgccagtggtttagtaccgttcgacccctggggccagggaaccctggtcaccgtctcctcagcttccaccaagggcccatcggtcttccccctggcgccctgctccaggagcacctctgggggcacagcggccctgggctgcctggtcaaggactacttcctcgtagcact

SEQ ID NO: 446011 - DNA, 397 bp, Homo sapiens
  misc_feature: HEFZJCU01ARS5U.21.60.F05.1.454.heavy.3.raw
tcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctggggccggggaaccctggtcaccgtctcctcggcctccaccaagggcccatcggtcttccccctggcgccctgctccaggagcacctccgagagcacagcggccctgggctgcctggtcaaggactacttcccgagcgacga

SEQ ID NO: 446012 - DNA, 482 bp, Homo sapiens; identical to SEQ ID NO: 444503
  misc_feature: HEFZJCU01ED25E.7.10.A10.1.454.heavy.3.raw

SEQ ID NO: 446013 - DNA, 498 bp, Homo sapiens; identical to SEQ ID NO: 445952
  misc_feature: HEFZJCU01EN18Z.11.71.G05.1.454.heavy.3.raw

SEQ ID NO: 446014 - DNA, 516 bp, Homo sapiens
  misc_feature: HEFZJCU01BSG4O.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctggggcacagcggccctgggctgcctggtcaaggactacttccgagtagtaca

SEQ ID NO: 446015 - DNA, 508 bp, Homo sapiens
  misc_feature: HEFZJCU01D40A7.14.71.G05.1.454.heavy.3.raw
cgtctagtaccacgaccggtgctcgatttagtgtcgtcgcaagagagaggggcccagccctgggattttcaggtgttttcattcggtgatcaggactgaacagagagaactcaccatggagtttgggctgagcgtgcgttttcttagtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgactcttc

SEQ ID NO: 446016 - DNA, 495 bp, Homo sapiens
  misc_feature: HEFZJCU01DQFMN.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgttaggctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaaatgaacagcctgagagccgatgacacggccgtgtattactgtgcgagagagtggggcccagaacgttactacgct

SEQ ID NO: 446017 - DNA, 390 bp, Homo sapiens
  misc_feature: HEFZJCU01EPK8L.51.46.E02.1.454.heavy.3.raw
cgatcgtatacacgaccggtgctcgatttagactcatctacagggaaaggggctggagtgggtggcagttatatcatatgatggaaagaataaatactatggagactccgtgaagggccgattcaccatctctagagacaatctcaaggagacagtgcatctgcaaatgaacagcctgagaggtgacgacacggctgtgtattactgtcacctcgagagcagcaattggagagaggtttttgatatctggggccaagggactatggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 446018 - DNA, 490 bp, Homo sapiens; identical to SEQ ID NO: 444500
  misc_feature: HEFZJCU01C14MF.19.53.E09.1.454.heavy.3.raw

SEQ ID NO: 446019 - DNA, 506 bp, Homo sapiens; identical to SEQ ID NO: 444696
  misc_feature: HEFZJCU01D9HUB.16.34.D01.1.454.heavy.3.raw

SEQ ID NO: 446020 - DNA, 488 bp, Homo sapiens
  misc_feature: HEFZJCU01CN521.51.12.B01.1.454.heavy.3.raw
cgatcgtatacacgaccggtgctcgatttagtagtgtagattccgcgggcacgaccggtgctcgatttagtagtgtagattccgcgggcacgaccggtgctcgatttagtacgcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttcccctggcaccctcctccaagagcacctctgggggcacagcggccctgggctgcctggtcaaggactactcctcgtagcact

SEQ ID NO: 446021 - DNA, 522 bp, Homo sapiens
  misc_feature: HEFZJCU01DKAS7.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgaggtagggccagctgctgggagcgtctacatatttcgacccctggggccagggaacccaggtcaccgtctcctcagcctccaccaagggcccatccgtcttcccctggcgccctgctccaggagcacctccgagagcacagcggccctgggcctgcctggtcaaggactacttcctacg

SEQ ID NO: 446022 - DNA, 385 bp, Homo sapiens; identical to SEQ ID NO: 444438
  misc_feature: HEFZJCU01DKJWR.18.60.F05.1.454.heavy.3.raw

SEQ ID NO: 446023 - DNA, 488 bp, Homo sapiens
  misc_feature: HEFZJCU01CB41X.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcctggcttgcctggtcaaggactactccacgagagta

SEQ ID NO: 446024 - DNA, 396 bp, Homo sapiens; identical to SEQ ID NO: 444469
  misc_feature: HEFZJCU01BC1GT.47.46.E02.1.454.heavy.3.raw

SEQ ID NO: 446025 - DNA, 492 bp, Homo sapiens; identical to SEQ ID NO: 444827
  misc_feature: HEFZJCU01D2BTC.4.28.C06.1.454.heavy.3.raw

SEQ ID NO: 446026 - DNA, 520 bp, Homo sapiens
  misc_feature: HEFZJCU01BBFU5.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtcttcccctggcaccctcctccaagagcacctctgggggcacagcggccctgggctg

SEQ ID NO: 446027 - DNA, 518 bp, Homo sapiens
  misc_feature: HEFZJCU01DFJPR.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 446028 - DNA, 418 bp, Homo sapiens
  misc_feature: HEFZJCU01B6S1Z.16.28.C06.1.454.heavy.3.raw
tgtactactccacgaccggtgctcgatttagagctcacgtattgggtttgggattgtctctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaaagggtactactttgactactggggccagggaaccctggtcaccgtctcctcagcctccaccaagggcccatcggtcttccccctggcgccctgctccaggagcacctccgagaacacagcggccctgggctgcctggtcaaggactacttccgagtagtaca

SEQ ID NO: 446029 - DNA, 432 bp, Homo sapiens
  misc_feature: HEFZJCU01DQPRU.11.39.D06.1.454.heavy.3.raw
cgagagataccacgaccggtgctcgatttagtgacatctcgcagttctttgggagtgtctaatgatatggtgactagactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 446030 - DNA, 393 bp, Homo sapiens
  misc_feature: HEFZJCU01CZ5LA.40.31.C09.1.454.heavy.3.raw
tctagcgactcacgaccggtgctcgatttagacgtctcatcaaggaaggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttccagtcgctaga

SEQ ID NO: 446031 - DNA, 396 bp, Homo sapiens; identical to SEQ ID NO: 444469
  misc_feature: HEFZJCU01CMFBG.47.46.E02.1.454.heavy.3.raw

SEQ ID NO: 446032 - DNA, 398 bp, Homo sapiens; identical to SEQ ID NO: 444798
  misc_feature: HEFZJCU01EQ0RC.4.60.F05.1.454.heavy.3.raw

SEQ ID NO: 446033 - DNA, 500 bp, Homo sapiens
  misc_feature: HEFZJCU01BXJ7W.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgat

SEQ ID NO: 446034 - DNA, 336 bp, Homo sapiens; identical to SEQ ID NO: 444510
  misc_feature: HEFZJCU01EH1NV.3.31.C09.1.454.heavy.3.raw

SEQ ID NO: 446035 - DNA, 400 bp, Homo sapiens; identical to SEQ ID NO: 444452
  misc_feature: HEFZJCU01EVV2J.47.24.C02.1.454.heavy.3.raw

SEQ ID NO: 446036 - DNA, 410 bp, Homo sapiens; identical to SEQ ID NO: 444689
  misc_feature: HEFZJCU01D724M.52.87.H10.1.454.heavy.3.raw

SEQ ID NO: 446037 - DNA, 496 bp, Homo sapiens
  misc_feature: HEFZJCU01DUDJ7.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctctttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaatatactatggagactccttcaagggccgattcaccatctccagagacaattccaagaacatggtgtatctgcaaatgaccagcctgagagccgaggacacgggtgttattactgtgggagaaatcctagtggctacg

SEQ ID NO: 446038 - DNA, 378 bp, Homo sapiens
  misc_feature: HEFZJCU01D25JU.2.86.H09.1.454.heavy.3.raw
acgctcgacacacgaccggtgctcgatttagtgctatagacttgggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 446039 - DNA, 517 bp, Homo sapiens
  misc_feature: HEFZJCU01DD5IQ.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggaccaa

SEQ ID NO: 446040 - DNA, 492 bp, Homo sapiens
  misc_feature: HEFZJCU01CQPA6.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggccaccctcctccaagagcacctctgggggcacagcggccctgggctgcctggtcaaggactacttccgtatctctcg

SEQ ID NO: 446041 - DNA, 412 bp, Homo sapiens
  misc_feature: HEFZJCU01DKABK.51.24.C02.1.454.heavy.3.raw
cgatcgtatacacgaccggtgctcgatttagtacagatcgttagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctggggcacagcggccctggctgcctggtcaaggactacttcctcgtagcact

SEQ ID NO: 446042 - DNA, 379 bp, Homo sapiens; identical to SEQ ID NO: 444450
  misc_feature: HEFZJCU01DWJDV.47.77.G11.1.454.heavy.3.raw

SEQ ID NO: 446043 - DNA, 384 bp, Homo sapiens; identical to SEQ ID NO: 445564
  misc_feature: HEFZJCU01COX51.47.29.C07.1.454.heavy.3.raw

SEQ ID NO: 446044 - DNA, 467 bp, Homo sapiens
  misc_feature: HEFZJCU01A9H70.48.23.C01.1.454.heavy.3.raw
agtatacatacacgaccggtgctcgatttagtacacgtgattagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 446045 - DNA, 396 bp, Homo sapiens; identical to SEQ ID NO: 444469
  misc_feature: HEFZJCU01B6LYN.47.46.E02.1.454.heavy.3.raw

SEQ ID NO: 446046 - DNA, 482 bp, Homo sapiens
  misc_feature: HEFZJCU01DCO5M.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctgcgccctgctccaggagcacctccgagagcacagcggccctgggctgcctggtcaaggactacttcccactactatg

SEQ ID NO: 446047 - DNA, 370 bp, Homo sapiens; identical to SEQ ID NO: 445884
  misc_feature: HEFZJCU01DOJWN.3.42.D09.1.454.heavy.3.raw

SEQ ID NO: 446048 - DNA, 407 bp, Homo sapiens
  misc_feature: HEFZJCU01D087M.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgct

SEQ ID NO: 446049 - DNA, 477 bp, Homo sapiens
  misc_feature: HEFZJCU01CAW0Y.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctgggctgcctggtcaaggactacttccgagtagtaca

SEQ ID NO: 446050 - DNA, 396 bp, Homo sapiens; identical to SEQ ID NO: 444469
  misc_feature: HEFZJCU01DRJNY.47.46.E02.1.454.heavy.3.raw

SEQ ID NO: 446051 - DNA, 412 bp, Homo sapiens; identical to SEQ ID NO: 444705
  misc_feature: HEFZJCU01D7HW9.51.60.F05.1.454.heavy.3.raw

SEQ ID NO: 446052 - DNA, 510 bp, Homo sapiens
  misc_feature: HEFZJCU01EB4Q9.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctggctgcctggtcaaggactactt

SEQ ID NO: 446053 - DNA, 493 bp, Homo sapiens
  misc_feature: HEFZJCU01DC3UG.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgctttgatgtctgggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 446054 - DNA, 386 bp, Homo sapiens
  misc_feature: HEFZJCU01DYOYE.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 446055 - DNA, 499 bp, Homo sapiens
  misc_feature: HEFZJCU01DRKMD.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaggactacttcctacgtcgtat

SEQ ID NO: 446056 - DNA, 520 bp, Homo sapiens
  misc_feature: HEFZJCU01D2DWL.12.40.D07.1.454.heavy.3.raw
atacgacgtacacgaccggtgctcgatttagtgatagagcgtaacaacagagggctcaccatggagtttgggctgagcggtggtttcgtcgtaggcgtctttaagtaggtgtcagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggctcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctgggggccaggggaccctggtcatcgtctccccagcctccaccaagggcccatcggtcttcccctgcg

SEQ ID NO: 446057 - DNA, 386 bp, Homo sapiens; identical to SEQ ID NO: 444449
  misc_feature: HEFZJCU01ATFWJ.27.46.E02.1.454.heavy.3.raw

SEQ ID NO: 446058 - DNA, 518 bp, Homo sapiens; identical to SEQ ID NO: 444718
  misc_feature: HEFZJCU01D5NBJ.9.34.D01.1.454.heavy.3.raw

SEQ ID NO: 446059 - DNA, 539 bp, Homo sapiens
  misc_feature: HEFZJCU01CFQIE.48.44.D11.1.454.heavy.3.raw
agtatacatacacgaccggtgctcgatttagcgcagtacgaagggggggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggtgtatctgcaaatggacaacctgaaaaccgaggacacggccgtttattattgtacttctgaggtgacgggaaccgctggctattggggccagggaaccct

SEQ ID NO: 446060 - DNA, 502 bp, Homo sapiens
  misc_feature: HEFZJCU01A79XD.48.27.C05.1.454.heavy.3.raw
agtatacatacacgaccggtgctcgatttagacgcgatcgaagggaggcttggtccagcctgggggggtccctgaaactctcctgtacagcctctgggttcgccttcacagcctctgggttcagcttcagtgcctctgctatgcactgggtccgccaggcttccgggagagggcttgagtgggtgcgtatagacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 446061 - DNA, 395 bp, Homo sapiens; identical to SEQ ID NO: 444517
  misc_feature: HEFZJCU01BF7BR.16.68.G02.1.454.heavy.3.raw

SEQ ID NO: 446062 - DNA, 500 bp, Homo sapiens
  misc_feature: HEFZJCU01BXUBC.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 446063 - DNA, 470 bp, Homo sapiens; identical to SEQ ID NO: 444866
  misc_feature: HEFZJCU01DX8XG.4.36.D03.1.454.heavy.3.raw

SEQ ID NO: 446064 - DNA, 507 bp, Homo sapiens
  misc_feature: HEFZJCU01EQ4RU.49.28.C06.1.454.heavy.3.raw
agtcgagagacacgaccggtgctcgatttagagctcacgtattgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggcccagggagccctggtcaccgtctcctcagcttccaccaagggcccatcggtcttcccctggcgccctgctccaggagcacctctgggggcacagcggcctgggctgcctggtcaaggactactcctctctcgta

SEQ ID NO: 446065 - DNA, 480 bp, Homo sapiens
  misc_feature: HEFZJCU01EIO0X.15.38.D05.1.454.heavy.3.raw
tctacgtagccacgaccggtgctcgatttagtatctgatagttgggtccctgagactcccctgtgtagcctctggattcaccttcagaggcttttggatgagttgggtccgccaggctccagggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaagggaggggacttactttgactactggggccggggaaccctggtcaccgtctcctcagcctccaccaagggcccatcggtcttccccctggcaccctcctccaagagcacctctgggggcacagcggccctgggctgcctggtcaaggactacttccgctacgtaga

SEQ ID NO: 446066 - DNA, 400 bp, Homo sapiens
  misc_feature: HEFZJCU01DVZGJ.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctgggacaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 446067 - DNA, 483 bp, Homo sapiens; identical to SEQ ID NO: 444924
  misc_feature: HEFZJCU01ETCNP.10.35.D02.1.454.heavy.3.raw

SEQ ID NO: 446068 - DNA, 401 bp, Homo sapiens
  misc_feature: HEFZJCU01A9JHY.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattacctaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 446069 - DNA, 518 bp, Homo sapiens; identical to SEQ ID NO: 444718
  misc_feature: HEFZJCU01ERQ41.9.34.D01.1.454.heavy.3.raw

SEQ ID NO: 446070 - DNA, 496 bp, Homo sapiens; identical to SEQ ID NO: 444697
  misc_feature: HEFZJCU01AEH65.16.37.D04.1.454.heavy.3.raw

SEQ ID NO: 446071 - DNA, 396 bp, Homo sapiens
  misc_feature: HEFZJCU01EQI34.53.29.C07.1.454.heavy.3.raw
cgcgtatacacacgaccggtgctcgatttagagtgctacgaagggaaaggggctggagtggattggggaagttcatcatagtggaagcaccaattacaacccgtccctcaagagtcgagtcaccatatcagtagacacgtccaagaaccagttctccctgaagttgagctctgtcaccgccgcggacacggctgtgtattactgtgcgagagttttggcaagttcgtctcgatttgacccttactttgacttctggggccagggaaccctggttaccgtctcctcagcctccaccaagggcccatcggtcttccccctggcaccctcctccaagagcacctctgggggcacagcggccctgggctgcctggtcaaggactacttcctcgtactgcg

SEQ ID NO: 446072 - DNA, 490 bp, Homo sapiens
  misc_feature: HEFZJCU01B873X.19.53.E09.1.454.heavy.3.raw
tactctcgtgcacgaccggtgctcgatttagagagagtgtgttgggtttggggaggcttggtacagcctggcaggtccctgagactctcccgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 446073 - DNA, 497 bp, Homo sapiens
  misc_feature: HEFZJCU01CWIHQ.22.78.H01.1.454.heavy.3.raw
acatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctgggggcacagcggccctgggctgcctggtcaaggactacttccacgcgtatgt

SEQ ID NO: 446074 - DNA, 481 bp, Homo sapiens; identical to SEQ ID NO: 444836
  misc_feature: HEFZJCU01BELH3.47.59.F04.1.454.heavy.3.raw

SEQ ID NO: 446075 - DNA, 437 bp, Homo sapiens; identical to SEQ ID NO: 444603
  misc_feature: HEFZJCU01AMPSM.3.21.B10.1.454.heavy.3.raw

SEQ ID NO: 446076 - DNA, 484 bp, Homo sapiens; identical to SEQ ID NO: 445311
  misc_feature: HEFZJCU01C6IND.11.23.C01.1.454.heavy.3.raw

SEQ ID NO: 446077 - DNA, 516 bp, Homo sapiens
  misc_feature: HEFZJCU01A7Q72.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcggcagtatatttctgtgcgagagagggggaggatgggttgaggggaattgttaattccatactacttttgaccactgggggccaggggaa

SEQ ID NO: 446078 - DNA, 517 bp, Homo sapiens
  misc_feature: HEFZJCU01EP945.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctggctgcctggtcaaggactacttccagacgtatca

SEQ ID NO: 446079 - DNA, 396 bp, Homo sapiens; identical to SEQ ID NO: 444469
  misc_feature: HEFZJCU01EX554.47.46.E02.1.454.heavy.3.raw

SEQ ID NO: 446080 - DNA, 471 bp, Homo sapiens
  misc_feature: HEFZJCU01D1155.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttccccctggcgccctgctccaggagcacctccgagagcacagcggccctgggctgcctggtcaaggactacttccctacagtgct

SEQ ID NO: 446081 - DNA, 506 bp, Homo sapiens
  misc_feature: HEFZJCU01DD233.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacgggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 446082 - DNA, 491 bp, Homo sapiens; identical to SEQ ID NO: 445333
  misc_feature: HEFZJCU01EYOBT.19.53.E09.1.454.heavy.3.raw

SEQ ID NO: 446083 - DNA, 530 bp, Homo sapiens
  misc_feature: HEFZJCU01CIEO6.12.39.D06.1.454.heavy.3.raw
  modified_base (377)..(377): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagaggggganagtggagtagaacgtaaatacgggaaaccgtttgactttgggccagggaaccctggtcaccgtctcctcagcctccaccaagggcccatcggtcttcccctggcaccctcctccaagagcacctctgggggcacagcggccctgggctgcctc

SEQ ID NO: 446084 - DNA, 482 bp, Homo sapiens; identical to SEQ ID NO: 444503
  misc_feature: HEFZJCU01CEIQQ.7.10.A10.1.454.heavy.3.raw

SEQ ID NO: 446085 - DNA, 523 bp, Homo sapiens
  misc_feature: HEFZJCU01B8G4S.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaagactacttcc

SEQ ID NO: 446086 - DNA, 521 bp, Homo sapiens; identical to SEQ ID NO: 445351
  misc_feature: HEFZJCU01ESG6M.19.86.H09.1.454.heavy.3.raw

SEQ ID NO: 446087 - DNA, 396 bp, Homo sapiens; identical to SEQ ID NO: 444469
  misc_feature: HEFZJCU01D16I8.47.46.E02.1.454.heavy.3.raw

SEQ ID NO: 446088 - DNA, 509 bp, Homo sapiens
  misc_feature: HEFZJCU01DIZSU.49.62.F07.1.454.heavy.3.raw
agtcgagagacacgaccggtgctcgatttagtagtcgcataaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttcccctggcaccctcctccaagagcacctctgggggcacagcggccctgggctgcctggtcaaggactacttcctctctcgact

SEQ ID NO: 446089 - DNA, 400 bp, Homo sapiens; identical to SEQ ID NO: 444452
  misc_feature: HEFZJCU01D2TY1.47.24.C02.1.454.heavy.3.raw

SEQ ID NO: 446090 - DNA, 505 bp, Homo sapiens
  misc_feature: HEFZJCU01ET0XO.52.53.E09.1.454.heavy.3.raw
cgcagtacgacacgaccggtgctcgatttagagagagtgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 446091 - DNA, 494 bp, Homo sapiens
  misc_feature: HEFZJCU01COSAV.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctgggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 446092 - DNA, 501 bp, Homo sapiens; identical to SEQ ID NO: 445999
  misc_feature: HEFZJCU01BQKU4.12.38.D05.1.454.heavy.3.raw

SEQ ID NO: 446093 - DNA, 504 bp, Homo sapiens
  misc_feature: HEFZJCU01EKS9K.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccgagggaaccctggtcatcgtctcctcagcctccaccaagggcccatcggtcttcccctggcaccctcctccaagagcacctctgggggcacagcgcctgggctgcctggtcaaggactacttccgatagtaca

SEQ ID NO: 446094 - DNA, 375 bp, Homo sapiens
  misc_feature: HEFZJCU01DXXEX.49.68.G02.1.454.heavy.3.raw
agtcgagagacacgaccggtgctcgatttagtcgatagtgaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 446095 - DNA, 507 bp, Homo sapiens
  misc_feature: HEFZJCU01B18PE.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 446096 - DNA, 543 bp, Homo sapiens
  misc_feature: HEFZJCU01D3GAX.51.15.B04.1.454.heavy.3.raw
cgatcgtatacacgaccggtgctcgatttagacagtatatatccgcgggattttagaaggtgtccaatgtgaggtgcacctggtggagtctgggggaggcttggtccagccgggggggtccctgagactctcctgtagagcctctggattcacctttagtaacttctggatgagctgggttcgccaggctccagggaaggggctggagtgggtggccaacataaacaaagatggaggtgagaagtactatgtggactctgtgaagggccgattcaccgtctccagagacaacgccaagaactcactgtatctgcaaatgaacagcctgagaaccagggacacggccctgtattactgtgcgagacacgggtcaaaacaactttggttcgggaaagactcctggggccaggggaccctggtcaccgtctcctcagcctccaccaagggcccatcggtcttcccctggcaccctcctccaagagcacctctgggggcacagcggccctgggctgcctggtcaaggactacttcctcgtagcactc

SEQ ID NO: 446097 - DNA, 496 bp, Homo sapiens
  misc_feature: HEFZJCU01AGV45.52.78.H01.1.454.heavy.3.raw
cgcagtacgacacgaccggtgctcgatttagtgtgagtagtttgggtttgggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaaggcccatcggtcttcccctggcaccctcctccaagagcacctctgggggcacagcggccctgggctgcctggtcaaggactacttcctatacgatcg

SEQ ID NO: 446098 - DNA, 533 bp, Homo sapiens
  misc_feature: HEFZJCU01ETRFN.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaaggg

SEQ ID NO: 446099 - DNA, 500 bp, Homo sapiens
  misc_feature: HEFZJCU01CEK14.10.38.D05.1.454.heavy.3.raw
catagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttcccctgacgccctgctccaggagcacctccgagagcacagcggccctgggctgcctggtcaaggactacttcccactact

SEQ ID NO: 446100 - DNA, 520 bp, Homo sapiens
  misc_feature: HEFZJCU01B0S41.40.81.H04.1.454.heavy.3.raw
tctagcgactcacgaccggtgctcgatttagtagtgtagattcgcgggtgtccttgggttttggggggaagaggaagactgacggtcctgccacagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctggg

SEQ ID NO: 446101 - DNA, 525 bp, Homo sapiens
  misc_feature: HEFZJCU01B2AH1.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctcccgagagcacagcggccctgggctgcctggtcaaggactacttcccgtgtctgat

SEQ ID NO: 446102 - DNA, 477 bp, Homo sapiens; identical to SEQ ID NO: 444659
  misc_feature: HEFZJCU01B9XUH.16.10.A10.1.454.heavy.3.raw

SEQ ID NO: 446103 - DNA, 516 bp, Homo sapiens
  misc_feature: HEFZJCU01D3VE6.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctgggctgcctggtcaagactactcctagagacacg

SEQ ID NO: 446104 - DNA, 491 bp, Homo sapiens
  misc_feature: HEFZJCU01CZD4N.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 446105 - DNA, 528 bp, Homo sapiens
  misc_feature: HEFZJCU01CRB6T.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatggacgtcgtggggccaagggaccac

SEQ ID NO: 446106 - DNA, 512 bp, Homo sapiens; identical to SEQ ID NO: 445306
  misc_feature: HEFZJCU01ARCMX.52.34.D01.1.454.heavy.3.raw

SEQ ID NO: 446107 - DNA, 338 bp, Homo sapiens; identical to SEQ ID NO: 444472
  misc_feature: HEFZJCU01AIZ9U.53.8.A08.1.454.heavy.3.raw

SEQ ID NO: 446108 - DNA, 378 bp, Homo sapiens
  misc_feature: HEFZJCU01CWRD1.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctccgagagcacagcggccctgggctgcctggtcaaggactacttcctacgtgagct

SEQ ID NO: 446109 - DNA, 466 bp, Homo sapiens; identical to SEQ ID NO: 445835
  misc_feature: HEFZJCU01CQ1QK.9.34.D01.1.454.heavy.3.raw

SEQ ID NO: 446110 - DNA, 489 bp, Homo sapiens; identical to SEQ ID NO: 444791
  misc_feature: HEFZJCU01CVJOJ.47.85.H08.1.454.heavy.3.raw

SEQ ID NO: 446111 - DNA, 400 bp, Homo sapiens; identical to SEQ ID NO: 444452
  misc_feature: HEFZJCU01BWYJL.47.24.C02.1.454.heavy.3.raw

SEQ ID NO: 446112 - DNA, 497 bp, Homo sapiens
  misc_feature: HEFZJCU01CQ8NQ.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtgcaactcctatgctttgatatctgggccaagggac

SEQ ID NO: 446113 - DNA, 464 bp, Homo sapiens; identical to SEQ ID NO: 445533
  misc_feature: HEFZJCU01B91AM.19.10.A10.1.454.heavy.3.raw

SEQ ID NO: 446114 - DNA, 524 bp, Homo sapiens
  misc_feature: HEFZJCU01A5ZL5.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcaccttttcgcttgacacgtccaacaaccagttttctctgaatcaaaaccccgagaccgccgcggacagcctcggcccctggggccccagaaacccc

SEQ ID NO: 446115 - DNA, 408 bp, Homo sapiens
  misc_feature: HEFZJCU01D228S.51.71.G05.1.454.heavy.3.raw
cgatcgtatacacgaccggtgctcgatttagtgtcgtcgcaagagagaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcact

SEQ ID NO: 446116 - DNA, 409 bp, Homo sapiens; identical to SEQ ID NO: 444519
  misc_feature: HEFZJCU01BU9AZ.3.41.D08.1.454.heavy.3.raw

SEQ ID NO: 446117 - DNA, 486 bp, Homo sapiens
  misc_feature: HEFZJCU01B3V0S.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 446118 - DNA, 506 bp, Homo sapiens; identical to SEQ ID NO: 444674
  misc_feature: HEFZJCU01B7K89.12.33.C11.1.454.heavy.3.raw

SEQ ID NO: 446119 - DNA, 528 bp, Homo sapiens
  misc_feature: HEFZJCU01B70FX.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttcccctggcaccctcctccaagagcacctctgggggcacagcggccctgggctgcctggtcaaggactacttccg

SEQ ID NO: 446120 - DNA, 490 bp, Homo sapiens
  misc_feature: HEFZJCU01DTOCF.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtctcccctggcgccctgctccaggagcacctccgagagcacagcggccctgggctgcctggtcaaggactacttccgtatctctcg

SEQ ID NO: 446121 - DNA, 529 bp, Homo sapiens
  misc_feature: HEFZJCU01BPRAN.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctggagacgtctaccgtgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctcccaccctccaccaagggcccatcggtcttccccctggcaccctcctccaagagcacctctgggggcacagcggccctgggctgcctggtcaaggactacttcccatactcgta

SEQ ID NO: 446122 - DNA, 477 bp, Homo sapiens
  misc_feature: HEFZJCU01CH1BQ.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctggggctgcctggtcaaggactactacgagagta

SEQ ID NO: 446123 - DNA, 502 bp, Homo sapiens
  misc_feature: HEFZJCU01CG8AI.10.38.D05.1.454.heavy.3.raw
  modified_base (460)..(460): a, c, t, g, unknown or other
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagccctccaccaagggcccatcggtcttcccctgcgcctgctccaggagcacctccgagagcacngcggccctgggctgcctggtcaaggactacttcccactacta

SEQ ID NO: 446124 - DNA, 506 bp, Homo sapiens
  misc_feature: HEFZJCU01BSM0D.48.44.D11.1.454.heavy.3.raw
agtatacatacacgaccggtgctcgatttagcgcagtacgaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 446125 - DNA, 312 bp, Homo sapiens; identical to SEQ ID NO: 444415
  misc_feature: HEFZJCU01DYUKA.7.10.A10.1.454.heavy.3.raw

SEQ ID NO: 446126 - DNA, 488 bp, Homo sapiens; identical to SEQ ID NO: 445778
  misc_feature: HEFZJCU01EAJ3U.18.70.G04.1.454.heavy.3.raw

SEQ ID NO: 446127 - DNA, 402 bp, Homo sapiens
  misc_feature: HEFZJCU01CAZYR.10.77.G11.1.454.heavy.3.raw
catagtagtgcacgaccggtgctcgatttagctagtcactcaagggaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 446128 - DNA, 512 bp, Homo sapiens
  misc_feature: HEFZJCU01DG9CK.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaaagaacacactgtatctgcaaatgaacagcctgagagccgacgacacggccatatattactgtgcgaaagcaccggcagttagtcacccatactactttgactactggggccg

SEQ ID NO: 446129 - DNA, 491 bp, Homo sapiens; identical to SEQ ID NO: 444592
  misc_feature: HEFZJCU01BT1KS.11.26.C04.1.454.heavy.3.raw

SEQ ID NO: 446130 - DNA, 339 bp, Homo sapiens; identical to SEQ ID NO: 444436
  misc_feature: HEFZJCU01D8HK0.47.38.D05.1.454.heavy.3.raw

SEQ ID NO: 446131 - DNA, 481 bp, Homo sapiens
  misc_feature: HEFZJCU01COJ9U.22.36.D03.1.454.heavy.3.raw
  modified_base (479)..(479): a, c, t, g, unknown or other
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccacgcgtangt

SEQ ID NO: 446132 - DNA, 519 bp, Homo sapiens
  misc_feature: HEFZJCU01DJU5W.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtattactgttcgtttggttctgactcgtcgggggaataccttcagcactggggccagggcaccctggtcaccgtctcctcagcctccaccaagggccatcggtcttcccctggcaccctcctccaagagcacctctgggggcac

SEQ ID NO: 446133 - DNA, 373 bp, Homo sapiens
  misc_feature: HEFZJCU01DE3ZL.9.14.B03.1.454.heavy.3.raw
tgatacgtctcacgaccggtgctcgatttagtgtgagtagtttgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 446134 - DNA, 392 bp, Homo sapiens
  misc_feature: HEFZJCU01ECIWP.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcggagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtat

SEQ ID NO: 446135 - DNA, 382 bp, Homo sapiens
  misc_feature: HEFZJCU01A9EIN.48.7.A07.1.454.heavy.3.raw
agtatacatacacgaccggtgctcgatttagcacgtgtcgcagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagagaaagtgttttatccctggggccagggaaccctggtcaccgtctcctcagcctccaccaagggcccatcggtttccccctggcaccctcctccaagagcacctctgggggcacagcggccctgggctgcctggtcaaggactacttcctatgtatact

SEQ ID NO: 446136 - DNA, 437 bp, Homo sapiens; identical to SEQ ID NO: 444603
  misc_feature: HEFZJCU01DS6O1.3.21.B10.1.454.heavy.3.raw

SEQ ID NO: 446137 - DNA, 507 bp, Homo sapiens
  misc_feature: HEFZJCU01EQCFR.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggccaccctcctccaagagcacctctgggggcacagcggccctgggctgcctggtcaaggactacttccgtactagacg

SEQ ID NO: 446138 - DNA, 379 bp, Homo sapiens; identical to SEQ ID NO: 444450
  misc_feature: HEFZJCU01CAAAR.47.77.G11.1.454.heavy.3.raw

SEQ ID NO: 446139 - DNA, 401 bp, Homo sapiens
  misc_feature: HEFZJCU01E2D9U.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctcccgagagcacagcggccctgggctgcctggtcaaggactacttcctacgtgagct

SEQ ID NO: 446140 - DNA, 403 bp, Homo sapiens; identical to SEQ ID NO: 444658
  misc_feature: HEFZJCU01D1Q7Q.14.60.F05.1.454.heavy.3.raw

SEQ ID NO: 446141 - DNA, 383 bp, Homo sapiens; identical to SEQ ID NO: 444477
  misc_feature: HEFZJCU01DJBF6.47.60.F05.1.454.heavy.3.raw

SEQ ID NO: 446142 - DNA, 494 bp, Homo sapiens
  misc_feature: HEFZJCU01B2QTK.49.57.F02.1.454.heavy.3.raw
agtcgagagacacgaccggtgctcgatttagctcgatatagttgggtttggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttcccctcggcaccctcctccaagagcacctctgggggcacagcggccctgggctgcctggtcaaggactacttcctctctcgact

SEQ ID NO: 446143 - DNA, 514 bp, Homo sapiens
  misc_feature: HEFZJCU01EY7QN.9.28.C06.1.454.heavy.3.raw
tgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattaccaaggacacctccaaaaaccaggtggtccttacaatgaccaacatggaccctgtggacacagccacatattactgtgcacacagtgtcatgactgcggtgactgttcctccctttggctacgtggggccagggaaccctggtcaccgtctcctcagcctccaccaagggccc

SEQ ID NO: 446144 - DNA, 402 bp, Homo sapiens
  misc_feature: HEFZJCU01CKAPS.22.80.H03.1.454.heavy.3.raw
acatacgcgtcacgaccggtgctcgatttagctgtgcgtcgaagggaaagggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgaggacctcatacgatttttggagtggttatttcccccctcctgactactggggccagggaaccctggtcaccgtctcctcagcctccaccaagggcccatcggtcttccccctggcaccctcctccaagagcacctctgggggcacagcggccctgggctgcctggtcaaggactacttccacgcgtatgt

SEQ ID NO: 446145 - DNA, 483 bp, Homo sapiens; identical to SEQ ID NO: 444924
  misc_feature: HEFZJCU01DJ4Z3.10.35.D02.1.454.heavy.3.raw

SEQ ID NO: 446146 - DNA, 396 bp, Homo sapiens; identical to SEQ ID NO: 444426
  misc_feature: HEFZJCU01EYFEY.18.31.C09.1.454.heavy.3.raw

SEQ ID NO: 446147 - DNA, 508 bp, Homo sapiens
  misc_feature: HEFZJCU01ED1ZC.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcgtcttcccctgcgcctgctccaggagcacctctggggcacagcgcccg

SEQ ID NO: 446148 - DNA, 506 bp, Homo sapiens
  misc_feature: HEFZJCU01CMNY3.48.45.E01.1.454.heavy.3.raw
agtatacatacacgaccggtgctcgatttagtgagtcagtaagggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaaggggacaagtggtctaccg

SEQ ID NO: 446149 - DNA, 518 bp, Homo sapiens
  misc_feature: HEFZJCU01D9FIL.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacg

SEQ ID NO: 446150 - DNA, 492 bp, Homo sapiens
  misc_feature: HEFZJCU01BKEN3.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggcgccctgctccaggagcacctctgggggcacagcggccctgggctgcctggtcaaggactacttccctacagtgct

SEQ ID NO: 446151 - DNA, 409 bp, Homo sapiens; identical to SEQ ID NO: 444519
  misc_feature: HEFZJCU01B5HDJ.3.41.D08.1.454.heavy.3.raw

SEQ ID NO: 446152 - DNA, 511 bp, Homo sapiens
  misc_feature: HEFZJCU01E0SFL.3.34.D01.1.454.heavy.3.raw
agacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 446153 - DNA, 524 bp, Homo sapiens
  misc_feature: HEFZJCU01CHKCN.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctggg

SEQ ID NO: 446154 - DNA, 310 bp, Homo sapiens
  misc_feature: HEFZJCU01DRLKZ.18.53.E09.1.454.heavy.3.raw
tacgagtatgcacgaccggtgctcgatttagagagagtgtgttgggttgggtgcccaagctggctggagggcacggtcaccacgctgctgagcagcctgagatctgaggacacggccgtgtattactgtgctagagagggacgtatagtgggagctccctttgacttctggggccagggaaccctggtcaccgtctcctcagcttccaccaagggcccatcggtcttcccctggcgccctgctccaggagcacctctgggggcacagcggccctgggctgcctggtcaaggactacttcccatactcgta

SEQ ID NO: 446155 - DNA, 512 bp, Homo sapiens
  misc_feature: HEFZJCU01DXW92.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctgcgccctgctccaggagcacctcg

SEQ ID NO: 446156 - DNA, 396 bp, Homo sapiens
  misc_feature: HEFZJCU01DAXBM.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcgccctgctccaggagcacctccgagagcacagcggccctgggctgcctggtcaaggactacttcccatactcgta

SEQ ID NO: 446157 - DNA, 395 bp, Homo sapiens; identical to SEQ ID NO: 444494
  misc_feature: HEFZJCU01EGPPS.47.46.E02.1.454.heavy.3.raw

SEQ ID NO: 446158 - DNA, 506 bp, Homo sapiens; identical to SEQ ID NO: 445243
  misc_feature: HEFZJCU01CJ8B6.48.27.C05.1.454.heavy.3.raw

SEQ ID NO: 446159 - DNA, 506 bp, Homo sapiens
  misc_feature: HEFZJCU01ER9H9.52.34.D01.1.454.heavy.3.raw
cgcagtacgacacgaccggtgctcgatttagatcgtctgtgttgggtctgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 446160 - DNA, 529 bp, Homo sapiens
  misc_feature: HEFZJCU01EQ8A9.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatggaaccccggtccg

SEQ ID NO: 446161 - DNA, 466 bp, Homo sapiens
  misc_feature: HEFZJCU01CQ8SH.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctggactgcctggtcaaggactacttccagacgtatca

SEQ ID NO: 446162 - DNA, 480 bp, Homo sapiens; identical to SEQ ID NO: 445011
  misc_feature: HEFZJCU01ETBIU.22.36.D03.1.454.heavy.3.raw

SEQ ID NO: 446163 - DNA, 505 bp, Homo sapiens; identical to SEQ ID NO: 444759
  misc_feature: HEFZJCU01EBLAV.10.38.D05.1.454.heavy.3.raw

SEQ ID NO: 446164 - DNA, 508 bp, Homo sapiens
  misc_feature: HEFZJCU01B82YG.49.81.H04.1.454.heavy.3.raw
agtcgagagacacgaccggtgctcgatttagtagtgtagattcgcggggagactgagtgtgagtgaacatgagtgagaaaaactaggatttgtgtggcactttctgataacggtgtccttctgtttgcaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtgaccccgtccactcggtacggacgtctggggccaagggaccacggtcactgt

SEQ ID NO: 446165 - DNA, 361 bp, Homo sapiens
  misc_feature: HEFZJCU01CMF2A.16.17.B06.1.454.heavy.3.raw
tgtactactccacgaccggtgctcgatttagtcgatagtgaaggggggggttccaactacaatccgtccctcaagagtcgactcaccctttcggtggacaagtccaagaaccacttctccctgcggttatgttctgtgaccgccgcggacacggccgtgtattactgtgcaaaacttacgacttttggagtggacctgttccggacatgttcgacccctggggccaaggaaccctggtcaccgtctctccagcttccaccaagggcccatccgtcttccccctggcgccctgctccaggagcacctccgagagcacagccgccctgggctgcctggtcaaggactacttccgagtagtaca

SEQ ID NO: 446166 - DNA, 528 bp, Homo sapiens
  misc_feature: HEFZJCU01BBR6U.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccaccctccaccaagggcccatcggtcttccccctggccaccctcctccaagagcacctcgtgggggcacagccggcccgtgggctgcctggtcaaggactacttcccatactcgta

SEQ ID NO: 446167 - DNA, 339 bp, Homo sapiens; identical to SEQ ID NO: 444436
  misc_feature: HEFZJCU01D1F8K.47.38.D05.1.454.heavy.3.raw

SEQ ID NO: 446168 - DNA, 375 bp, Homo sapiens
  misc_feature: HEFZJCU01CFJ6I.13.78.H01.1.454.heavy.3.raw
tcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 446169 - DNA, 500 bp, Homo sapiens; identical to SEQ ID NO: 445720
  misc_feature: HEFZJCU01CUXHL.3.20.B09.1.454.heavy.3.raw

SEQ ID NO: 446170 - DNA, 442 bp, Homo sapiens
  misc_feature: HEFZJCU01DTRIF.10.11.A11.1.454.heavy.3.raw
catagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagtttgaccactggggccagggcatgctagtcaccgtctccccagcctccaccaagggcccatcggtcttcccctggcaccctcctccaagagcacctctgggggcacagcggccctgggctgcctggtcaaggactacttcccactactatg

SEQ ID NO: 446171 - DNA, 480 bp, Homo sapiens
  misc_feature: HEFZJCU01CLFL5.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 446172 - DNA, 405 bp, Homo sapiens
  misc_feature: HEFZJCU01BRUCV.48.45.E01.1.454.heavy.3.raw
agtatacatacacgaccggtgctcgatttagtgagtcagtaagggaaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 446173 - DNA, 518 bp, Homo sapiens
  misc_feature: HEFZJCU01A4ERV.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggtttcgttgttaggctatttcaaaaggtgtccagtgtgaggtgcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattactggggccagggaa

SEQ ID NO: 446174 - DNA, 313 bp, Homo sapiens; identical to SEQ ID NO: 444447
  misc_feature: HEFZJCU01CMQVL.7.10.A10.1.454.heavy.3.raw

SEQ ID NO: 446175 - DNA, 485 bp, Homo sapiens; identical to SEQ ID NO: 444908
  misc_feature: HEFZJCU01C70EP.12.40.D07.1.454.heavy.3.raw

SEQ ID NO: 446176 - DNA, 377 bp, Homo sapiens
  misc_feature: HEFZJCU01DWS21.4.30.C08.1.454.heavy.3.raw
agcactgtagcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtatctgcaaatgaacagcctgagagccgaggacacggctatttattactgtgtgaaagagaactggttcttcgatctctggggccgtggcaccctggtcactgtctcctcagcctccaccaagggcccatcggtcttccccctggcgccctgctccaggagcacctccgagagcacagcggccctgggctgcctggtcaaggactacttccctacagct

SEQ ID NO: 446177 - DNA, 504 bp, Homo sapiens
  misc_feature: HEFZJCU01E0ZDZ.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttccccctggcaccctcctccaagagcacctctgggggcacagcggccctgggctgcctggtcaaggactacttccgctacgtaga

SEQ ID NO: 446178 - DNA, 491 bp, Homo sapiens; identical to SEQ ID NO: 444592
  misc_feature: HEFZJCU01A1PBF.11.26.C04.1.454.heavy.3.raw

SEQ ID NO: 446179 - DNA, 500 bp, Homo sapiens
  misc_feature: HEFZJCU01DDMB4.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 446180 - DNA, 519 bp, Homo sapiens; identical to SEQ ID NO: 445330
  misc_feature: HEFZJCU01CF8Y7.7.78.H01.1.454.heavy.3.raw

SEQ ID NO: 446181 - DNA, 509 bp, Homo sapiens; identical to SEQ ID NO: 444586
  misc_feature: HEFZJCU01B5U0Q.12.78.H01.1.454.heavy.3.raw

SEQ ID NO: 446182 - DNA, 391 bp, Homo sapiens
  misc_feature: HEFZJCU01BIJVE.48.41.D08.1.454.heavy.3.raw
agtatacatacacgaccggtgctcgatttagtcacgcgagaaagggaaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccgagagcacagcggccctgggctgcctggtcaagaactacttcctatgtatact

SEQ ID NO: 446183 - DNA, 485 bp, Homo sapiens
  misc_feature: HEFZJCU01BSK8D.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctcggcaccctccctccaagagcacctctgggggcacagcggcccgtgggctgcctggtcaaggactacttcctagagacacg

SEQ ID NO: 446184 - DNA, 403 bp, Homo sapiens; identical to SEQ ID NO: 444540
  misc_feature: HEFZJCU01EV0A8.16.72.G06.1.454.heavy.3.raw

SEQ ID NO: 446185 - DNA, 396 bp, Homo sapiens; identical to SEQ ID NO: 444469
  misc_feature: HEFZJCU01DGBJD.47.46.E02.1.454.heavy.3.raw

SEQ ID NO: 446186 - DNA, 515 bp, Homo sapiens
  misc_feature: HEFZJCU01D1EGN.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggacc

SEQ ID NO: 446187 - DNA, 377 bp, Homo sapiens; identical to SEQ ID NO: 444596
  misc_feature: HEFZJCU01DSI6P.47.77.G11.1.454.heavy.3.raw

SEQ ID NO: 446188 - DNA, 396 bp, Homo sapiens; identical to SEQ ID NO: 444469
  misc_feature: HEFZJCU01CLHCE.47.46.E02.1.454.heavy.3.raw

SEQ ID NO: 446189 - DNA, 491 bp, Homo sapiens; identical to SEQ ID NO: 444592
  misc_feature: HEFZJCU01DDCFQ.11.26.C04.1.454.heavy.3.raw

SEQ ID NO: 446190 - DNA, 484 bp, Homo sapiens
  misc_feature: HEFZJCU01EA6L1.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacg

SEQ ID NO: 446191 - DNA, 492 bp, Homo sapiens
  misc_feature: HEFZJCU01CD6O7.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 446192 - DNA, 518 bp, Homo sapiens
  misc_feature: HEFZJCU01EU2YM.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactactcctagagacacg

SEQ ID NO: 446193 - DNA, 483 bp, Homo sapiens; identical to SEQ ID NO: 444932
  misc_feature: HEFZJCU01CSC23.7.10.A10.1.454.heavy.3.raw

SEQ ID NO: 446194 - DNA, 457 bp, Homo sapiens
  misc_feature: HEFZJCU01B6JQV.48.71.G05.1.454.heavy.3.raw
agtatacatacacgaccggtgctcgatttagtgtcgtcgcaagagagaggggcaagggcgccagatggtccttcctcgtgagtcccaggaccaccctcggcctctggggtccagagtccaacaacccccgggccctccccggcctcaacctgagagagattcccagggacgttttccctggggtcctgacattgttgtcacaatgtgacaactgagtcgacccctggggccagagaaccctggtcaccgtctcctcagggtgaggatggacattccgccactgtgatcacttccactactgcggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatgtatact

SEQ ID NO: 446195 - DNA, 372 bp, Homo sapiens
  misc_feature: HEFZJCU01D8ZBH.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaaactgaactctatgaccgccacagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 446196 - DNA, 379 bp, Homo sapiens; identical to SEQ ID NO: 444450
  misc_feature: HEFZJCU01D1O0L.47.77.G11.1.454.heavy.3.raw

SEQ ID NO: 446197 - DNA, 521 bp, Homo sapiens
  misc_feature: HEFZJCU01DZODI.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgtttcgagacatgccgaccgagagcattatcggcagtacggtttgatatttggggccaaggggacaagggtcaccgtctccgcagcctccaccg

SEQ ID NO: 446198 - DNA, 485 bp, Homo sapiens
  misc_feature: HEFZJCU01CWQ4V.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgccctgctccaggagcacctccgagagcacagcggccctgggctgcctggtcaggactacttcctacgtgagct

SEQ ID NO: 446199 - DNA, 470 bp, Homo sapiens; identical to SEQ ID NO: 444866
  misc_feature: HEFZJCU01D8MU5.4.36.D03.1.454.heavy.3.raw

SEQ ID NO: 446200 - DNA, 527 bp, Homo sapiens
  misc_feature: HEFZJCU01EK2JY.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccagggaaccctggtcaccgtctcctcagcctccaccg

SEQ ID NO: 446201 - DNA, 496 bp, Homo sapiens; identical to SEQ ID NO: 444697
  misc_feature: HEFZJCU01BBJ9D.16.37.D04.1.454.heavy.3.raw

SEQ ID NO: 446202 - DNA, 513 bp, Homo sapiens
  misc_feature: HEFZJCU01CD2Q2.49.87.H10.1.454.heavy.3.raw
agtcgagagacacgaccggtgctcgatttagcagtactgcgttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgaccccgtggggccagggagccctggtcaccgtctcctcagcttccaccaagggcccatcggtccttccccctggccgccctcgctcccaggagcacctctgggggcacagcggccctgggctgcctggtcaaggactacttctctctcgta

SEQ ID NO: 446203 - DNA, 408 bp, Homo sapiens; identical to SEQ ID NO: 446115
  misc_feature: HEFZJCU01CAHOJ.51.71.G05.1.454.heavy.3.raw

SEQ ID NO: 446204 - DNA, 449 bp, Homo sapiens
  misc_feature: HEFZJCU01A3ADU.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 446205 - DNA, 516 bp, Homo sapiens
  misc_feature: HEFZJCU01CMEIT.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggagtaccttctagcactgggccgac

SEQ ID NO: 446206 - DNA, 520 bp, Homo sapiens
  misc_feature: HEFZJCU01A0VYX.49.65.F10.1.454.heavy.3.raw
agtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaagtaaaagtactattcggactccttgaagggccgattcaccatctccagagacaattccaagaacaccttgcatctacaaatgcacagtctgagacctgaggacacggctgtgtattactgtgcggaagggggaggggtattttggctagttggacccacttgactacgtggggccaac

SEQ ID NO: 446207 - DNA, 492 bp, Homo sapiens; identical to SEQ ID NO: 444827
  misc_feature: HEFZJCU01EZ0JC.4.28.C06.1.454.heavy.3.raw

SEQ ID NO: 446208 - DNA, 463 bp, Homo sapiens
  misc_feature: HEFZJCU01CTU9J.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 446209 - DNA, 396 bp, Homo sapiens; identical to SEQ ID NO: 444426
  misc_feature: HEFZJCU01A2WY6.18.31.C09.1.454.heavy.3.raw

SEQ ID NO: 446210 - DNA, 467 bp, Homo sapiens; identical to SEQ ID NO: 444941
  misc_feature: HEFZJCU01CPD0S.16.78.H01.1.454.heavy.3.raw

SEQ ID NO: 446211 - DNA, 483 bp, Homo sapiens; identical to SEQ ID NO: 444532
  misc_feature: HEFZJCU01DZ4BT.47.59.F04.1.454.heavy.3.raw

SEQ ID NO: 446212 - DNA, 375 bp, Homo sapiens; identical to SEQ ID NO: 444459
  misc_feature: HEFZJCU01DDZW6.48.59.F04.1.454.heavy.3.raw

SEQ ID NO: 446213 - DNA, 388 bp, Homo sapiens
  misc_feature: HEFZJCU01E07Z2.9.53.E09.1.454.heavy.3.raw
tgatacgtctcacgaccggtgctcgatttagagagagtgtgttgggtttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctcggcgccctgctccaggagcacctccgagagcacagcggccctgggctgcctggtcaaggactacttccagacgtatca

SEQ ID NO: 446214 - DNA, 525 bp, Homo sapiens
  misc_feature: HEFZJCU01DBB90.14.55.E11.1.454.heavy.3.raw
cgtctagtaccacgaccggtgctcgatttagcactcgcacgttgggtttggggggaagaggaagactgacggtccccccaggagttcaggtccctgacactctcatgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcggcccgtgggctgcctggtcaaggacttaccg

SEQ ID NO: 446215 - DNA, 479 bp, Homo sapiens
  misc_feature: HEFZJCU01DW330.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccacgcgtatgt

SEQ ID NO: 446216 - DNA, 486 bp, Homo sapiens; identical to SEQ ID NO: 444861
  misc_feature: HEFZJCU01CM3OI.47.55.E11.1.454.heavy.3.raw

SEQ ID NO: 446217 - DNA, 400 bp, Homo sapiens; identical to SEQ ID NO: 444452
  misc_feature: HEFZJCU01DJJBG.47.24.C02.1.454.heavy.3.raw

SEQ ID NO: 446218 - DNA, 527 bp, Homo sapiens
  misc_feature: HEFZJCU01A85CU.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccgagacg

SEQ ID NO: 446219 - DNA, 483 bp, Homo sapiens; identical to SEQ ID NO: 444639
  misc_feature: HEFZJCU01CEST1.11.23.C01.1.454.heavy.3.raw

SEQ ID NO: 446220 - DNA, 395 bp, Homo sapiens; identical to SEQ ID NO: 444517
  misc_feature: HEFZJCU01CJ15X.16.68.G02.1.454.heavy.3.raw

SEQ ID NO: 446221 - DNA, 487 bp, Homo sapiens
  misc_feature: HEFZJCU01CVYUJ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggccatcggtcttcccctggcgccctgctccaggagcacctccgagagcacagcggccctgggctgcctggtcaaggactacttccatactcgta

SEQ ID NO: 446222 - DNA, 453 bp, Homo sapiens
  misc_feature: HEFZJCU01AMUVO.52.55.E11.1.454.heavy.3.raw
cgcagtacgacacgaccggtgctcgatttagcactcgcacgttgggtttggggggaagaggaagactgacggtccccccaggagttcaggtgctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgatcg

SEQ ID NO: 446223 - DNA, 424 bp, Homo sapiens
  misc_feature: HEFZJCU01C5SSM.51.41.D08.1.454.heavy.3.raw
cgatcgtatacacgaccggtgctcgatttagtcacgcgagaaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 446224 - DNA, 511 bp, Homo sapiens
  misc_feature: HEFZJCU01D7ZDC.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgtccg

SEQ ID NO: 446225 - DNA, 523 bp, Homo sapiens; identical to SEQ ID NO: 445239
  misc_feature: HEFZJCU01D9711.9.78.H01.1.454.heavy.3.raw

SEQ ID NO: 446226 - DNA, 415 bp, Homo sapiens; identical to SEQ ID NO: 444794
  misc_feature: HEFZJCU01CHTV9.14.74.G08.1.454.heavy.3.raw

SEQ ID NO: 446227 - DNA, 395 bp, Homo sapiens; identical to SEQ ID NO: 445116
  misc_feature: HEFZJCU01E08PN.40.38.D05.1.454.heavy.3.raw

SEQ ID NO: 446228 - DNA, 519 bp, Homo sapiens
  misc_feature: HEFZJCU01DX86R.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctcag

SEQ ID NO: 446229 - DNA, 521 bp, Homo sapiens
  misc_feature: HEFZJCU01B82UZ.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagcggtggtttcgtcgtaggcgtactttagtaaggtgtccagtgtgagggacaattggtggagtctgggggaggcttggtccagccggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagcacgggtatttattattgtgtgcgagatctggatttccttcgaaatgaagtgtggttcgatgtgtttg

SEQ ID NO: 446230 - DNA, 395 bp, Homo sapiens
  misc_feature: HEFZJCU01EB0VE.14.25.C03.1.454.heavy.3.raw
cgtctagtaccacgaccggtgctcgatttagtagtgtagatttgggtttgggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 446231 - DNA, 511 bp, Homo sapiens
  misc_feature: HEFZJCU01BJVZP.51.21.B10.1.454.heavy.3.raw
cgatcgtatacacgaccggtgctcgatttagtgtcgtcgcaagggggagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgacttctggggccagggaaccctggtctaccg

SEQ ID NO: 446232 - DNA, 440 bp, Homo sapiens
  misc_feature: HEFZJCU01CLWWQ.48.22.B11.1.454.heavy.3.raw
agtatacatacacgaccggtgctcgatttagacgacagctcagggcacgaccggtgctcgatttagacacatacgcagggaaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 446233 - DNA, 483 bp, Homo sapiens; identical to SEQ ID NO: 444924
  misc_feature: HEFZJCU01C0V8B.10.35.D02.1.454.heavy.3.raw

SEQ ID NO: 446234 - DNA, 403 bp, Homo sapiens; identical to SEQ ID NO: 445456
  misc_feature: HEFZJCU01BFLKY.3.72.G06.1.454.heavy.3.raw

SEQ ID NO: 446235 - DNA, 509 bp, Homo sapiens
  misc_feature: HEFZJCU01CTOWH.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctgcgcctgctccagagcacctctggggcacagcggccg

SEQ ID NO: 446236 - DNA, 379 bp, Homo sapiens; identical to SEQ ID NO: 444450
  misc_feature: HEFZJCU01C2WA0.47.77.G11.1.454.heavy.3.raw

SEQ ID NO: 446237 - DNA, 486 bp, Homo sapiens; identical to SEQ ID NO: 446117
  misc_feature: HEFZJCU01ETUQZ.51.14.B03.1.454.heavy.3.raw

SEQ ID NO: 446238 - DNA, 523 bp, Homo sapiens
  misc_feature: HEFZJCU01CAJSU.49.25.C03.1.454.heavy.3.raw
agtcgagagacacgaccggtgctcgatttagtagtgtagatttgggtttggggagctctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgcgtggacgaggacgcccgtacggcgggtt

SEQ ID NO: 446239 - DNA, 509 bp, Homo sapiens; identical to SEQ ID NO: 445824
  misc_feature: HEFZJCU01C4LVZ.9.14.B03.1.454.heavy.3.raw

SEQ ID NO: 446240 - DNA, 379 bp, Homo sapiens; identical to SEQ ID NO: 444450
  misc_feature: HEFZJCU01DHLM5.47.77.G11.1.454.heavy.3.raw

SEQ ID NO: 446241 - DNA, 379 bp, Homo sapiens; identical to SEQ ID NO: 444450
  misc_feature: HEFZJCU01B5612.47.77.G11.1.454.heavy.3.raw

SEQ ID NO: 446242 - DNA, 379 bp, Homo sapiens
  misc_feature: HEFZJCU01CF96Q.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtcccggcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 446243 - DNA, 523 bp, Homo sapiens
  misc_feature: HEFZJCU01EZTT3.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcccggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccaccctccaccaagggcccatcggtcttcccctggcaccctcctccaagagcacctctgggggcacagcggccctgggctgcctggtcaaggactacttcccatactcgta

SEQ ID NO: 446244 - DNA, 527 bp, Homo sapiens
  misc_feature: HEFZJCU01C5GM1.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctcccaccctccaccaagggcccatcggtcttccccctggcaccctcctccaagagcacctctgggggcacagcggccctgggctgcctggtcaaggactacttcccatactcgta

SEQ ID NO: 446245 - DNA, 499 bp, Homo sapiens
  misc_feature: HEFZJCU01EF274.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggactattccagacgtatca

SEQ ID NO: 446246 - DNA, 512 bp, Homo sapiens
  misc_feature: HEFZJCU01A3MH2.19.67.G01.1.454.heavy.3.raw
tactctcgtgcacgaccggtgctcgatttagagtatacatattgggtttgggggggagaggagcccagcactgggattcctaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggcca

SEQ ID NO: 446247 - DNA, 509 bp, Homo sapiens
  misc_feature: HEFZJCU01COXSO.51.43.D10.1.454.heavy.3.raw
cgatcgtatacacgaccggtgctcgatttagactagcagtaagggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaaactaccttcattactggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 446248 - DNA, 489 bp, Homo sapiens
  misc_feature: HEFZJCU01DCKA6.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctcctcagcctccaccaaggcccatcggtcttccctggcgccctgctccaggagcacctccgagagcacagcggccctgggctgcctggtcaaggactactcccacgagagta

SEQ ID NO: 446249 - DNA, 330 bp, Homo sapiens; identical to SEQ ID NO: 445264
  misc_feature: HEFZJCU01A3KSH.53.44.D11.1.454.heavy.3.raw

SEQ ID NO: 446250 - DNA, 399 bp, Homo sapiens
  misc_feature: HEFZJCU01BP56R.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagct

SEQ ID NO: 446251 - DNA, 423 bp, Homo sapiens; identical to SEQ ID NO: 444772
  misc_feature: HEFZJCU01EEXHD.16.78.H01.1.454.heavy.3.raw

SEQ ID NO: 446252 - DNA, 528 bp, Homo sapiens
  misc_feature: HEFZJCU01ELR6X.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggactacggtgactactgggggttcgaccccgtggggccagggaaccctggtcaccgtctcctcagcctccaccg

SEQ ID NO: 446253 - DNA, 512 bp, Homo sapiens
  misc_feature: HEFZJCU01A1FW2.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagcgtgggttttccgttgttaggctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccg

SEQ ID NO: 446254 - DNA, 387 bp, Homo sapiens; identical to SEQ ID NO: 445235
  misc_feature: HEFZJCU01BBDCU.9.63.F08.1.454.heavy.3.raw

SEQ ID NO: 446255 - DNA, 463 bp, Homo sapiens
  misc_feature: HEFZJCU01CO2OT.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatggatactgggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 446256 - DNA, 524 bp, Homo sapiens
  misc_feature: HEFZJCU01EC0EN.49.15.B04.1.454.heavy.3.raw
agtcgagagacacgaccggtgctcgatttagacagtatatatccgcggggatgggaaacactttctgagagtcctggacctcctgtgcaagaacatgaaacatctgtgggtcttccttctcctggtgacagctcccagatgggtcctgtcccaggtgcagctgcaggagtcgggcccaggactggtgaagccttcggagaccctgtccctcacctgcactgtctctggtggctccgttagtagttactattggagctgggtccggcagtcccccgggaagggactggaatggattggctatatctactacagtggaagcaccgattacaatccctccctcaagagtcgagtcagcatttcagccgacaggtccaagaaccagttctccctgaagttgaagtctgtgaccgctgcggacacggccgtgtatttctgtgcggttgatgattaccttcgggggactcatcgtactttcgacatctggggccgagggacaacagtcatcgtctcttcaacctccaccg

SEQ ID NO: 446257 - DNA, 535 bp, Homo sapiens
  misc_feature: HEFZJCU01CIZOB.14.57.F02.1.454.heavy.3.raw
  modified_base (515)..(515): a, c, t, g, unknown or other
cgtctagtaccacgaccggtgctcgatttagctcgatatagttgggtttgggctgagtgggctcgttctaggtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaagggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggccatcggtcttcccctggcacctcctccaagngcacctctgggggcacagcc

SEQ ID NO: 446258 - DNA, 511 bp, Homo sapiens
  misc_feature: HEFZJCU01CNHAP.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagagcacctctgggggcacagcggccctgggctgcctggtcaaggactacttccgtacta

SEQ ID NO: 446259 - DNA, 522 bp, Homo sapiens
  misc_feature: HEFZJCU01B02MV.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccaggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggactccgtgtcaccgtctcctcagt

SEQ ID NO: 446260 - DNA, 497 bp, Homo sapiens
  misc_feature: HEFZJCU01E22K9.4.7.A07.1.454.heavy.3.raw
agcactgtagcacgaccggtgctcgatttagcacgtgtcgcaggggctgagagaggagcccagccctgggatttttcaggtgttttcatttggtgatcaggactgaacagagagaactcaccatggagtctgggctgagcgtggcgttttcttaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcaaggattggggtagtagaccgactc

SEQ ID NO: 446261 - DNA, 502 bp, Homo sapiens
  misc_feature: HEFZJCU01EKDWA.22.36.D03.1.454.heavy.3.raw
  modified_base (480)..(480): a, c, t, g, unknown or other
  modified_base (485)..(485): a, c, t, g, unknown or other
  modified_base (490)..(490): a, c, t, g, unknown or other
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatcnctagnggcgngcgacgacggcg

SEQ ID NO: 446262 - DNA, 489 bp, Homo sapiens; identical to SEQ ID NO: 444791
  misc_feature: HEFZJCU01DN9AO.47.85.H08.1.454.heavy.3.raw

SEQ ID NO: 446263 - DNA, 396 bp, Homo sapiens; identical to SEQ ID NO: 444426
  misc_feature: HEFZJCU01BQ0AW.18.31.C09.1.454.heavy.3.raw

SEQ ID NO: 446264 - DNA, 396 bp, Homo sapiens; identical to SEQ ID NO: 444469
  misc_feature: HEFZJCU01D9SJA.47.46.E02.1.454.heavy.3.raw

SEQ ID NO: 446265 - DNA, 410 bp, Homo sapiens
  misc_feature: HEFZJCU01EC590.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctcgtggggcacagcggcccgtgggctgcctggtcaaggactacttccgagtgcgtct

SEQ ID NO: 446266 - DNA, 502 bp, Homo sapiens
  misc_feature: HEFZJCU01EBKZF.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtggggaccg

SEQ ID NO: 446267 - DNA, 514 bp, Homo sapiens
  misc_feature: HEFZJCU01AS5YE.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaaggggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccgagcgggagttccaagtactcttgtacg

SEQ ID NO: 446268 - DNA, 496 bp, Homo sapiens; identical to SEQ ID NO: 444697
  misc_feature: HEFZJCU01D6B7J.16.37.D04.1.454.heavy.3.raw

SEQ ID NO: 446269 - DNA, 517 bp, Homo sapiens
  misc_feature: HEFZJCU01CZ9R3.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtaattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagcgcctgggctgcctggtcaggactactctacg

SEQ ID NO: 446270 - DNA, 523 bp, Homo sapiens
  misc_feature: HEFZJCU01CDJ2G.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccg

SEQ ID NO: 446271 - DNA, 509 bp, Homo sapiens
  misc_feature: HEFZJCU01EZ9UC.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaatagcctgagagccgacgacacggccatatattactgtgcgaaagcaccggcagttagtcacccatactactttgactactgggccg

SEQ ID NO: 446272 - DNA, 385 bp, Homo sapiens; identical to SEQ ID NO: 444438
  misc_feature: HEFZJCU01DAV93.18.60.F05.1.454.heavy.3.raw

SEQ ID NO: 446273 - DNA, 409 bp, Homo sapiens; identical to SEQ ID NO: 444519
  misc_feature: HEFZJCU01CKX09.3.41.D08.1.454.heavy.3.raw

SEQ ID NO: 446274 - DNA, 491 bp, Homo sapiens; identical to SEQ ID NO: 445531
  misc_feature: HEFZJCU01BCODD.11.38.D05.1.454.heavy.3.raw

SEQ ID NO: 446275 - DNA, 379 bp, Homo sapiens; identical to SEQ ID NO: 444450
  misc_feature: HEFZJCU01DGKSS.47.77.G11.1.454.heavy.3.raw

SEQ ID NO: 446276 - DNA, 502 bp, Homo sapiens
  misc_feature: HEFZJCU01EUERI.22.86.H09.1.454.heavy.3.raw
acatacgcgtcacgaccggtgctcgatttagtgctatagacttgggtttgggctgagcgtggtttcgtcgttaggctctttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggcactggtcaccgtctcttcagcctccaccaagggcccatcggtcttccccctggccgcctgctcc

SEQ ID NO: 446277 - DNA, 430 bp, Homo sapiens
  misc_feature: HEFZJCU01B62EC.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttcccctggcaccctcctccaagagcacctctgggggcacagcggccctggctgcctggtcaaggactacttccgtatctctcg

SEQ ID NO: 446278 - DNA, 389 bp, Homo sapiens
  misc_feature: HEFZJCU01D2AEZ.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctgggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 446279 - DNA, 478 bp, Homo sapiens
  misc_feature: HEFZJCU01BI0OT.22.36.D03.1.454.heavy.3.raw
acatacgcgtcacgaccggtgctcgatttagctgcgtcacgatctctcttggggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggcctgggctgcctggtcaaggactacttccagacgtatca

SEQ ID NO: 446280 - DNA, 501 bp, Homo sapiens
  misc_feature: HEFZJCU01CAWTB.52.53.E09.1.454.heavy.3.raw
cgcagtacgacacgaccggtgctcgatttagagagagtgtgttgggtttggggtctgggagaggagcccagcactgggattccgaggtgtttccattcagtgatctgcactgaacacagaggactcgccatggagtttgggctgagcgtggtttcgtgtaggctatttaaaaggtgtccagtgtggagtgcaggtggtggagtctgggggaggcttggtccagcctggtggttccctgagactctcctgtgcagcctctggattctccgtcagcagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgt

SEQ ID NO: 446281 - DNA, 465 bp, Homo sapiens; identical to SEQ ID NO: 444805
  misc_feature: HEFZJCU01CA955.19.10.A10.1.454.heavy.3.raw

SEQ ID NO: 446282 - DNA, 496 bp, Homo sapiens
  misc_feature: HEFZJCU01C6VU3.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcggtcttcccctggcgccctgctccaggagcacctctgggggcacagcggccctgggctgcctggtcaaggactacttcctacgtcgtat

SEQ ID NO: 446283 - DNA, 379 bp, Homo sapiens
  misc_feature: HEFZJCU01BSBNR.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 446284 - DNA, 410 bp, Homo sapiens; identical to SEQ ID NO: 445251
  misc_feature: HEFZJCU01CW87R.19.25.C03.1.454.heavy.3.raw

SEQ ID NO: 446285 - DNA, 489 bp, Homo sapiens
  misc_feature: HEFZJCU01DYF2X.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctcctcagcctccaccaaggcccatcggtcttcccctgcgcctgctccaggagcacctccgagagcacagcggccctgggctgcctggtcaaggactacttcccacgagagta

SEQ ID NO: 446286 - DNA, 510 bp, Homo sapiens; identical to SEQ ID NO: 445542
  misc_feature: HEFZJCU01BL47W.16.21.B10.1.454.heavy.3.raw

SEQ ID NO: 446287 - DNA, 526 bp, Homo sapiens
  misc_feature: HEFZJCU01BV3BW.19.67.G01.1.454.heavy.3.raw
tactctcgtgcacgaccggtgctcgatttagagtatacatattgggtttgggggggagaggagcccagcactgggattccgaggtgtttccattcggtgctcagtactgaacacagaggactcaccatggagtttggctgacctgggttttccttgctgcaatttcaggaggtgtccagtgtgaggtgcaactggtggagactggcggaggcttggtccagcctgggcggtctctgagactgtcctgtgaaccctctgggtctccgtcagcagcgactgtattgcctgggtccgccaggctccgggggaggaagaggccggagtgggtcgcaggttatttttataggtgggacgacattctacggagactccatggagggccgattcaccatctccagagtacttttctcagaacacactgtctcttcaaatgaacagcctgagggccgaggacacggccgtctattattgtgtgagtagtttatggcgatggctgggtggacagatcacgtgggggccaggggaa

SEQ ID NO: 446288 - DNA, 460 bp, Homo sapiens; identical to SEQ ID NO: 444688
  misc_feature: HEFZJCU01CNX12.53.12.B01.1.454.heavy.3.raw

SEQ ID NO: 446289 - DNA, 496 bp, Homo sapiens
  misc_feature: HEFZJCU01DAMDC.7.76.G10.1.454.heavy.3.raw
  modified_base (438)..(438): a, c, t, g, unknown or other
cgtgtctctacacgaccggtgctcgatttagtcactcatacagggagaggctcttctgtgtgtagtggttgtgcagagcctcatgcatcacggagcatgagaagacgttccctgctgccacctgctcttgtccacggtgagcttgctgtagaggaagaaggagccggcgtggtccagcctgggaggtccctgagactctcctgtgcagcctctggattcaccttcacttcctatgatttccactggtccgccagactccagacaagggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctnactgataaaccggactggttcgacccctggggccagggaaccctggtcaccgtctcct

SEQ ID NO: 446290 - DNA, 372 bp, Homo sapiens; identical to SEQ ID NO: 444727
  misc_feature: HEFZJCU01EWAYD.3.42.D09.1.454.heavy.3.raw

SEQ ID NO: 446291 - DNA, 507 bp, Homo sapiens
  misc_feature: HEFZJCU01DYCIA.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggagcacctctggggcacagcggcctgggctgcctggtcaaggactacttcccata

SEQ ID NO: 446292 - DNA, 518 bp, Homo sapiens
  misc_feature: HEFZJCU01BT2D8.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctct

SEQ ID NO: 446293 - DNA, 515 bp, Homo sapiens
  misc_feature: HEFZJCU01C31I9.52.75.G09.1.454.heavy.3.raw
cgcagtacgacacgaccggtgctcgatttagtatagacatcaggggagctctgagagaggagcccagccctgggattttcaggtgttttcatttggtgatcaggactgaacagagagaactcaccatggagtttgggctgagctggctttttcttgtggctattttaaaaggtgtccatggtgaggtgcggctgttggaatccgggggggcttgatacagcctggggggtccctgagactctcctgtgctgcctctggattcagtttcagtgacttagccatgagctgggtccgccaggctccaggaaggggctggaatgggtctcagtcgttactgctggacttactaccacatactacgcagactccgtgaagggccgttcgccatctccagagacaattccaagaataccctatatctgcaaatgagcagcctgagagccgaggacacggccgtatattactgtgcgatgggaagtagtggttactactactactttgacaactggggaccg

SEQ ID NO: 446294 - DNA, 399 bp, Homo sapiens; identical to SEQ ID NO: 444690
  misc_feature: HEFZJCU01C4M09.4.79.H02.1.454.heavy.3.raw

SEQ ID NO: 446295 - DNA, 503 bp, Homo sapiens
  misc_feature: HEFZJCU01EFP61.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 446296 - DNA, 496 bp, Homo sapiens
  misc_feature: HEFZJCU01C3MEK.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactac

SEQ ID NO: 446297 - DNA, 400 bp, Homo sapiens; identical to SEQ ID NO: 444452
  misc_feature: HEFZJCU01E09HF.47.24.C02.1.454.heavy.3.raw

SEQ ID NO: 446298 - DNA, 500 bp, Homo sapiens
  misc_feature: HEFZJCU01CPKJ2.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttgggggtggtt

SEQ ID NO: 446299 - DNA, 382 bp, Homo sapiens
  misc_feature: HEFZJCU01DEUN9.22.46.E02.1.454.heavy.3.raw
acatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccagacgtatca

SEQ ID NO: 446300 - DNA, 491 bp, Homo sapiens; identical to SEQ ID NO: 444592
  misc_feature: HEFZJCU01A05FJ.11.26.C04.1.454.heavy.3.raw

SEQ ID NO: 446301 - DNA, 518 bp, Homo sapiens
  misc_feature: HEFZJCU01DFGWS.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggccaaggggaccg

SEQ ID NO: 446302 - DNA, 384 bp, Homo sapiens; identical to SEQ ID NO: 444454
  misc_feature: HEFZJCU01DE65S.11.61.F06.1.454.heavy.3.raw

SEQ ID NO: 446303 - DNA, 491 bp, Homo sapiens; identical to SEQ ID NO: 446104
  misc_feature: HEFZJCU01C72ZD.3.34.D01.1.454.heavy.3.raw

SEQ ID NO: 446304 - DNA, 491 bp, Homo sapiens; identical to SEQ ID NO: 446104
  misc_feature: HEFZJCU01AKTLH.3.34.D01.1.454.heavy.3.raw

SEQ ID NO: 446305 - DNA, 436 bp, Homo sapiens; identical to SEQ ID NO: 444849
  misc_feature: HEFZJCU01DP4BB.53.40.D07.1.454.heavy.3.raw

SEQ ID NO: 446306 - DNA, 381 bp, Homo sapiens; identical to SEQ ID NO: 444427
  misc_feature: HEFZJCU01BC6JW.9.53.E09.1.454.heavy.3.raw

SEQ ID NO: 446307 - DNA, 379 bp, Homo sapiens; identical to SEQ ID NO: 444450
  misc_feature: HEFZJCU01EQG6W.47.77.G11.1.454.heavy.3.raw

SEQ ID NO: 446308 - DNA, 385 bp, Homo sapiens; identical to SEQ ID NO: 444438
  misc_feature: HEFZJCU01EA8PE.18.60.F05.1.454.heavy.3.raw

SEQ ID NO: 446309 - DNA, 371 bp, Homo sapiens; identical to SEQ ID NO: 444919
  misc_feature: HEFZJCU01DCRQM.3.1.A01.1.454.heavy.3.raw

SEQ ID NO: 446310 - DNA, 511 bp, Homo sapiens
  misc_feature: HEFZJCU01DY790.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtcgtggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgccg

SEQ ID NO: 446311 - DNA, 518 bp, Homo sapiens; identical to SEQ ID NO: 445453
  misc_feature: HEFZJCU01AU1QH.9.34.D01.1.454.heavy.3.raw

SEQ ID NO: 446312 - DNA, 510 bp, Homo sapiens; identical to SEQ ID NO: 445700
  misc_feature: HEFZJCU01ECUFP.14.25.C03.1.454.heavy.3.raw

SEQ ID NO: 446313 - DNA, 518 bp, Homo sapiens; identical to SEQ ID NO: 444718
  misc_feature: HEFZJCU01E11CZ.9.34.D01.1.454.heavy.3.raw

SEQ ID NO: 446314 - DNA, 410 bp, Homo sapiens
  misc_feature: HEFZJCU01A53AQ.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagtcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 446315 - DNA, 391 bp, Homo sapiens; identical to SEQ ID NO: 444514
  misc_feature: HEFZJCU01CAETC.12.24.C02.1.454.heavy.3.raw

SEQ ID NO: 446316 - DNA, 339 bp, Homo sapiens
  misc_feature: HEFZJCU01DFXDD.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacatgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 446317 - DNA, 396 bp, Homo sapiens; identical to SEQ ID NO: 444469
  misc_feature: HEFZJCU01AE7VX.47.46.E02.1.454.heavy.3.raw

SEQ ID NO: 446318 - DNA, 491 bp, Homo sapiens; identical to SEQ ID NO: 444749
  misc_feature: HEFZJCU01B7SMJ.11.13.B02.1.454.heavy.3.raw

SEQ ID NO: 446319 - DNA, 475 bp, Homo sapiens
  misc_feature: HEFZJCU01ANAT4.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctctaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttcccctggcaccctcctccaagagcacctctgggggcacagcggcctgggctgcctggtcaaggactacttccgagtagtaca

SEQ ID NO: 446320 - DNA, 549 bp, Homo sapiens
  misc_feature: HEFZJCU01DQQHT.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctcctagggacacacgcggcccgtccggtcggtcgtcgcgtcggtacgaacggtaccttacctaccgacgtaacgtactacctacgta

SEQ ID NO: 446321 - DNA, 534 bp, Homo sapiens
  misc_feature: HEFZJCU01EIINZ.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtcttcccctc

SEQ ID NO: 446322 - DNA, 497 bp, Homo sapiens
  misc_feature: HEFZJCU01CNGL3.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctcctgggggcacagcggccctgggctgcctggtcaaggactacttccgagtagtaca

SEQ ID NO: 446323 - DNA, 533 bp, Homo sapiens
  misc_feature: HEFZJCU01CDWDF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccacctaacgggcccatcggtccttcccctcggccgccctcg

SEQ ID NO: 446324 - DNA, 521 bp, Homo sapiens; identical to SEQ ID NO: 445317
  misc_feature: HEFZJCU01CGB5I.12.40.D07.1.454.heavy.3.raw

SEQ ID NO: 446325 - DNA, 411 bp, Homo sapiens; identical to SEQ ID NO: 445580
  misc_feature: HEFZJCU01DXJVZ.51.31.C09.1.454.heavy.3.raw

SEQ ID NO: 446326 - DNA, 482 bp, Homo sapiens
  misc_feature: HEFZJCU01EIYU3.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggtcgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 446327 - DNA, 382 bp, Homo sapiens
  misc_feature: HEFZJCU01BJYSA.53.44.D11.1.454.heavy.3.raw
cgcgtatacacacgaccggtgctcgatttagcgcagtacgaagggtggggggtcttgatcctgaaaatggtggaagagtctacgcgcagaagtttcagggcagagtcaccgtgacccaggacacatctagagacacagcctacatggaactcagaagcctgaggtctgaagacacggccgtctattattgtacaacccttgttgttcgggaggattgggctgacaattggttcgacccctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 446328 - DNA, 323 bp, Homo sapiens; identical to SEQ ID NO: 444416
  misc_feature: HEFZJCU01CJ14F.47.38.D05.1.454.heavy.3.raw

SEQ ID NO: 446329 - DNA, 466 bp, Homo sapiens; identical to SEQ ID NO: 445835
  misc_feature: HEFZJCU01BZPAK.9.34.D01.1.454.heavy.3.raw

SEQ ID NO: 446330 - DNA, 494 bp, Homo sapiens; identical to SEQ ID NO: 445975
  misc_feature: HEFZJCU01CLFIU.48.70.G04.1.454.heavy.3.raw

SEQ ID NO: 446331 - DNA, 508 bp, Homo sapiens
  misc_feature: HEFZJCU01ESDP2.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtctgg

SEQ ID NO: 446332 - DNA, 500 bp, Homo sapiens; identical to SEQ ID NO: 445028
  misc_feature: HEFZJCU01BEO2G.13.12.B01.1.454.heavy.3.raw

SEQ ID NO: 446333 - DNA, 496 bp, Homo sapiens
  misc_feature: HEFZJCU01BXA5B.13.33.C11.1.454.heavy.3.raw
  modified_base (471)..(471): a, c, t, g, unknown or other
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaattgnaacgatgctttgatatgtgggaccg

SEQ ID NO: 446334 - DNA, 516 bp, Homo sapiens
  misc_feature: HEFZJCU01AUH8O.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggc

SEQ ID NO: 446335 - DNA, 508 bp, Homo sapiens
  misc_feature: HEFZJCU01A1Y53.18.39.D06.1.454.heavy.3.raw
  modified_base (471)..(471): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaaggcccatcggtcttcccctggcgccctgctccaggagcacctctggggcacancggcctgggctgcctggtcaaggactacttcccatac

SEQ ID NO: 446336 - DNA, 491 bp, Homo sapiens; identical to SEQ ID NO: 445531
  misc_feature: HEFZJCU01A679T.11.38.D05.1.454.heavy.3.raw

SEQ ID NO: 446337 - DNA, 354 bp, Homo sapiens
  misc_feature: HEFZJCU01AM2BU.49.39.D06.1.454.heavy.3.raw
agtcgagagacacgaccggtgctcgatttagtgacatctcgcagttctttgggtagtaatcgttgcctgccgcacagtaatacacagccgagtcaccatctccagacacaattccaagaacacggtgtttctgctggtgaacagcctgagaactgaggacacggctgtgtattactgtgcggcaggcaacgattactacccgaaggactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446338 - DNA, 468 bp, Homo sapiens
  misc_feature: HEFZJCU01BYZMY.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaaggcccatcggtcttcccctggcgcctgctccaggagcacctccgagagcacagcgtccctgggctgcctggtcaaggactacttccctacagtgct

SEQ ID NO: 446339 - DNA, 509 bp, Homo sapiens; identical to SEQ ID NO: 445824
  misc_feature: HEFZJCU01A5DFE.9.14.B03.1.454.heavy.3.raw

SEQ ID NO: 446340 - DNA, 500 bp, Homo sapiens
  misc_feature: HEFZJCU01CZNBK.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctagaatgggtggcagttatatcatatgatggaagctatcaatattacgcaggattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccctggcgccctgctccaggagcacctcctgggggcacagcggccctgggctgcctggtcaaggactacttcctacgtcgtat

SEQ ID NO: 446341 - DNA, 480 bp, Homo sapiens
  misc_feature: HEFZJCU01CE80J.51.86.H09.1.454.heavy.3.raw
cgatcgtatacacgaccggtgctcgatttagtgctatagacttgggtttggggggtttggggggaagaggaagactgacggtcctcccaggagttcaggtgctgggcaccgtgggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaacttttgatatctggggccacgggacaatggtcaccgtctcttcagcttccaccaagggcccatcggtcttccccctggcgccctgctccaggagcacctctgggggcacagcggccctgggctgcctggtcaaggactacttcctcgtagcact

SEQ ID NO: 446342 - DNA, 523 bp, Homo sapiens
  misc_feature: HEFZJCU01D3VOH.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggccaccctcctccaagagcacctctgggggcacacgg

SEQ ID NO: 446343 - DNA, 465 bp, Homo sapiens
  misc_feature: HEFZJCU01EMK6C.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtactccgtctcgtcagcctccaccaagggcccatcggtcttccccctggcgccctgctccaggagcacctccgagagcacagcggccctgggctgcctggtcaaggactacttcccacgagagta

SEQ ID NO: 446344 - DNA, 480 bp, Homo sapiens; identical to SEQ ID NO: 445011
  misc_feature: HEFZJCU01CDZNP.22.36.D03.1.454.heavy.3.raw

SEQ ID NO: 446345 - DNA, 400 bp, Homo sapiens; identical to SEQ ID NO: 444452
  misc_feature: HEFZJCU01EYV6J.47.24.C02.1.454.heavy.3.raw

SEQ ID NO: 446346 - DNA, 494 bp, Homo sapiens; identical to SEQ ID NO: 444700
  misc_feature: HEFZJCU01EUW88.4.21.B10.1.454.heavy.3.raw

SEQ ID NO: 446347 - DNA, 394 bp, Homo sapiens
  misc_feature: HEFZJCU01D6YNK.52.41.D08.1.454.heavy.3.raw
cgcagtacgacacgaccggtgctcgatttagtcacgcgagaaagggaaaggggctggagtgggtttcatacagtagtggttctagtactttcgcaaagtacgcagactctgtgaagggccgattcaccgtgtccagagacaacgccaagaactcaatgtatctgcagatgagcaacctgagagtcgacgacacggctgtttattactgttcgagactagcggatttttgggggtcggaatcacttgactactggggccagggagccctggtcaccgtctcctctgcctccaccaagggcccatcggtcttccccctggcaccctcctccaagagcacctctgggggcacagcggccctgggctgcctggtcaaggactacttcctatacgatcg

SEQ ID NO: 446348 - DNA, 519 bp, Homo sapiens
  misc_feature: HEFZJCU01ET849.12.40.D07.1.454.heavy.3.raw
atacgacgtacacgaccggtgctcgatttagtgatagagcgtaacaacagagggctcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatacatgggggcttgttctggggccaggggaccctggtcatcgtctccccagcctccaccaagggcccatcggtcttccccctgcg

SEQ ID NO: 446349 - DNA, 531 bp, Homo sapiens
  misc_feature: HEFZJCU01CXDPM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtcctagcctgggcggtccctgacactcgcctgtgttgcctctggatttcccttcaatttctattccatgcactgggtccgccaggctccaggcaaggggctcgagtgggtggcacttattgcacatgatggcgtcaacaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccctagcctccaccaagggcccatccggtccttccccctggccgccctc

SEQ ID NO: 446350 - DNA, 500 bp, Homo sapiens
  misc_feature: HEFZJCU01EH6VZ.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactaccaaaaacacgctgtatctccaaatgaacagcctcagatctgaggacacggctatctactactgtgtgaaagaattgggtttcagtggctacttt

SEQ ID NO: 446351 - DNA, 511 bp, Homo sapiens
  misc_feature: HEFZJCU01EDSO4.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctgggggcacagcggccctgggctgcctggtcaaggactacttcccatac

SEQ ID NO: 446352 - DNA, 529 bp, Homo sapiens
  misc_feature: HEFZJCU01DMXLR.49.31.C09.1.454.heavy.3.raw
agtcgagagacacgaccggtgctcgatttagacgtctcatcaaggaaggaaggggtctgagagaggagcccagccctgggattttcaggtgttttcatttggtgatcaggactgaacagagagaactcaccatggagtttgggctgagctggctttttcttgtggcttttttaaaaggtgtccagtgtgaggtggagctgttggagtctgggggaggcttggtacaatttggggggtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggac

SEQ ID NO: 446353 - DNA, 510 bp, Homo sapiens
  misc_feature: HEFZJCU01DMBMT.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagctttgaattttggggccaagggacaatggtcatcgtctcctcagcctccaccaagggcccatcggtcttccccctggcaccctcctccaagagcacctctgggggcacagcggccctgggctgccg

SEQ ID NO: 446354 - DNA, 407 bp, Homo sapiens
  misc_feature: HEFZJCU01DMOC0.13.42.D09.1.454.heavy.3.raw
tcacgtactacacgaccggtgctcgatttagacacatacgcagggaaaggggctggagtgggtaggtttcattaggagcaattctcatgatgggacaacagaatacgccgcgtctgtaaaaggcagattcaccatctcaagagatgagtccagaagcatcgccttttctgcagatgagtagcctgaagaccgaggacacagccatctattactgtgctagagagtattgcagtcctacgacctgctatggggccttggtggccactggggccagggcaccctggtcaccgtctccgcagcctccaccaagggcccatcggtcttccccctggcaccctcctccaagagcacctctggggcacagcggccctgggctgcctggtcaaggactacttccgtactagacg

SEQ ID NO: 446355 - DNA, 379 bp, Homo sapiens; identical to SEQ ID NO: 444450
  misc_feature: HEFZJCU01EOL4T.47.77.G11.1.454.heavy.3.raw

SEQ ID NO: 446356 - DNA, 491 bp, Homo sapiens; identical to SEQ ID NO: 444592
  misc_feature: HEFZJCU01EVCZV.11.26.C04.1.454.heavy.3.raw

SEQ ID NO: 446357 - DNA, 374 bp, Homo sapiens
  misc_feature: HEFZJCU01EJHZD.51.75.G09.1.454.heavy.3.raw
cgatcgtatacacgaccggtgctcgatttagtatagacatcagggaggacatactacgcagactccgtcaagggccggttcaccatctccagagacaattccgagaactcggtgtctctgcaaatgagcagcctgagagccgaggacacggccgtatatttctgtgcgaaagacttcggacaactggaagtacgtatgttcgcattcagcagctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 446358 - DNA, 486 bp, Homo sapiens
  misc_feature: HEFZJCU01AU0SB.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagaaccgaggacacggccgtatattattgtataggttatggtggtaattcgggcccctggggccagggaaccgtggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 446359 - DNA, 427 bp, Homo sapiens; identical to SEQ ID NO: 444708
  misc_feature: HEFZJCU01D6KYL.9.34.D01.1.454.heavy.3.raw

SEQ ID NO: 446360 - DNA, 494 bp, Homo sapiens
  misc_feature: HEFZJCU01B3844.52.15.B04.1.454.heavy.3.raw
cgcagtacgacacgaccggtgctcgatttagacagtatatatccgcggggtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgaggggccgattcaccatatccagagacaactcccaagatgtgatatatctacaaatgaacagcctgagacctgaggacacggctgtatattattgtgcgtcagggggcagtgcctggccacgtgatgcttttgatttctggggccaagggacattcgtcaccgtctcctcagcctccaccaagggcccatcggtcttcccctggcaccctcctccaagagcacctctgggggcacagcggccct

SEQ ID NO: 446361 - DNA, 350 bp, Homo sapiens; identical to SEQ ID NO: 444420
  misc_feature: HEFZJCU01EP9U8.40.36.D03.1.454.heavy.3.raw

SEQ ID NO: 446362 - DNA, 481 bp, Homo sapiens
  misc_feature: HEFZJCU01BY3AQ.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 446363 - DNA, 518 bp, Homo sapiens; identical to SEQ ID NO: 444718
  misc_feature: HEFZJCU01DQRYM.9.34.D01.1.454.heavy.3.raw

SEQ ID NO: 446364 - DNA, 487 bp, Homo sapiens
  misc_feature: HEFZJCU01AJX4G.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcacatctccagagacaacgccaagaactccctgtatctgcaaatgaacagtctgagagctgaggacacggccttgtattactgtgcgaaggaggt

SEQ ID NO: 446365 - DNA, 508 bp, Homo sapiens
  misc_feature: HEFZJCU01AQMAX.48.82.H05.1.454.heavy.3.raw
agtatacatacacgaccggtgctcgatttagtcgagctctctcgcgggcacgaccggtgctcgatttagtcgatagtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccaggagcacctctgggggcacagcggccctgggctgcctggtcaac

SEQ ID NO: 446366 - DNA, 379 bp, Homo sapiens; identical to SEQ ID NO: 444450
  misc_feature: HEFZJCU01AFKNO.47.77.G11.1.454.heavy.3.raw

SEQ ID NO: 446367 - DNA, 522 bp, Homo sapiens
  misc_feature: HEFZJCU01COVUC.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggctactcccttgactactggggccagggaaccctggtcaccg

SEQ ID NO: 446368 - DNA, 436 bp, Homo sapiens; identical to SEQ ID NO: 444686
  misc_feature: HEFZJCU01BSMRP.40.27.C05.1.454.heavy.3.raw

SEQ ID NO: 446369 - DNA, 398 bp, Homo sapiens; identical to SEQ ID NO: 444524
  misc_feature: HEFZJCU01CRDY9.7.60.F05.1.454.heavy.3.raw

SEQ ID NO: 446370 - DNA, 487 bp, Homo sapiens
  misc_feature: HEFZJCU01A7IWY.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggccatcggtcttcccctggcgccctgctccaggagcacctccgagagcacagcggccctgggctgcctgtcaaggactacttcctacgtgagct

SEQ ID NO: 446371 - DNA, 517 bp, Homo sapiens
  misc_feature: HEFZJCU01AORY4.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactactcctatacg

SEQ ID NO: 446372 - DNA, 491 bp, Homo sapiens; identical to SEQ ID NO: 445333
  misc_feature: HEFZJCU01D7858.19.53.E09.1.454.heavy.3.raw

SEQ ID NO: 446373 - DNA, 392 bp, Homo sapiens; identical to SEQ ID NO: 444456
  misc_feature: HEFZJCU01DGSLV.7.60.F05.1.454.heavy.3.raw

SEQ ID NO: 446374 - DNA, 526 bp, Homo sapiens
  misc_feature: HEFZJCU01CYFDY.49.43.D10.1.454.heavy.3.raw
  modified_base (513)..(513): a, c, t, g, unknown or other
agtcgagagacacgaccggtgctcgatttagactagcagtaaggggctgagagaggagcccagccctgggattttcaggtgttttcatttggtgatcaggactgaacagagagaactcaccatggagtttgggctgagcgtggcgttttcttaggtggctattttaaaaggtgtccactgtgaggtgcaactgttggaatctgggggagacttggtaaagccgggggggtccctgagactctcctgtgcagtctcgggattcacctttagagtctatgccatgcactgggttcgccaggccccagggaagggctggagtgggtctctgccattagtggaagtggtgatctcagatactacggagactccgtgaagggccggttcaccatctccagagacaactccaagaatacgctctatctacacatgaaaaacctagagccgacgacacggcctctattactgtgcaaagtgggtcacggactacgatgatactagtggctattctcggtnactctttgactcg

SEQ ID NO: 446375 - DNA, 396 bp, Homo sapiens; identical to SEQ ID NO: 444568
  misc_feature: HEFZJCU01EBUTU.47.46.E02.1.454.heavy.3.raw

SEQ ID NO: 446376 - DNA, 505 bp, Homo sapiens
  misc_feature: HEFZJCU01EUS7Z.10.53.E09.1.454.heavy.3.raw
catagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctccaaagacaatttgaagaacacgctgtttctgcaaatgaacagcctgagagctgaggacacggctgtgtatactgttcgtttggttctgactcgtcggggaata

SEQ ID NO: 446377 - DNA, 381 bp, Homo sapiens; identical to SEQ ID NO: 444427
  misc_feature: HEFZJCU01C0QIM.9.53.E09.1.454.heavy.3.raw

SEQ ID NO: 446378 - DNA, 391 bp, Homo sapiens
  misc_feature: HEFZJCU01AW8AW.16.24.C02.1.454.heavy.3.raw
tgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 446379 - DNA, 522 bp, Homo sapiens
  misc_feature: HEFZJCU01EUHC0.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgtaccgtcgcagacacggctgtctattattgtgcgagacggcaaatatggttcagggagttcgactactggggccagggaaccctggtcaccgtctcctcagcctccaccaaggg

SEQ ID NO: 446380 - DNA, 503 bp, Homo sapiens
  misc_feature: HEFZJCU01AYL1F.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagcgtggtttcgtgtaggctcttaaagtgtcagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgtccttcggtccgcgggactttctgggggccaac

SEQ ID NO: 446381 - DNA, 392 bp, Homo sapiens; identical to SEQ ID NO: 445098
  misc_feature: HEFZJCU01EXY3A.4.42.D09.1.454.heavy.3.raw

SEQ ID NO: 446382 - DNA, 483 bp, Homo sapiens; identical to SEQ ID NO: 444924
  misc_feature: HEFZJCU01B6DIM.10.35.D02.1.454.heavy.3.raw

SEQ ID NO: 446383 - DNA, 436 bp, Homo sapiens; identical to SEQ ID NO: 444686
  misc_feature: HEFZJCU01BL9KB.40.27.C05.1.454.heavy.3.raw

SEQ ID NO: 446384 - DNA, 388 bp, Homo sapiens
  misc_feature: HEFZJCU01C7GOU.16.24.C02.1.454.heavy.3.raw
tgtactactccacgaccggtgctcgatttagtacagatcgttagggaagggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcaccctcctccaagagcacctctggggcacagcggccctgggctgcctggtcaaggactacttccgagtagtaca

SEQ ID NO: 446385 - DNA, 521 bp, Homo sapiens
  misc_feature: HEFZJCU01EE9ZA.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggcaccctcctccaagagcacctctgggggcacacgg

SEQ ID NO: 446386 - DNA, 491 bp, Homo sapiens; identical to SEQ ID NO: 446104
  misc_feature: HEFZJCU01DXJP8.3.34.D01.1.454.heavy.3.raw

SEQ ID NO: 446387 - DNA, 434 bp, Homo sapiens
  misc_feature: HEFZJCU01ECW6D.11.67.G01.1.454.heavy.3.raw
cgagagataccacgaccggtgctcgatttagagtatacatattgggtttgggtgcccaagctgctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 446388 - DNA, 530 bp, Homo sapiens
  misc_feature: HEFZJCU01AWOTO.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtcttcccctggccaccctcctccagagcacctcgtgggggcacgagcggccc

SEQ ID NO: 446389 - DNA, 490 bp, Homo sapiens
  misc_feature: HEFZJCU01DWY21.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactactccgagtgcgtct

SEQ ID NO: 446390 - DNA, 537 bp, Homo sapiens; identical to SEQ ID NO: 445697
  misc_feature: HEFZJCU01CXWJ1.14.57.F02.1.454.heavy.3.raw

SEQ ID NO: 446391 - DNA, 377 bp, Homo sapiens
  misc_feature: HEFZJCU01CBYYV.48.59.F04.1.454.heavy.3.raw
agtatacatacacgaccggtgctcgatttagtacacacacttagggattgggagtatttacccacagtgggacgcacctactacaacccgtccctcaaagtcgaggcgaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 446392 - DNA, 511 bp, Homo sapiens
  misc_feature: HEFZJCU01CIZEC.53.32.C10.1.454.heavy.3.raw
cgcgtatacacacgaccggtgctcgatttagtatagacatcaacacacaaagggggagagaggagcccagccctgggattctcaggtgttctcatttggtgatcaggactgaacagagagaactcaccatggagtttgggctgagcgtgcgttcttacgttgtggctatttaaaggtgtccagtgtgaggtgcaactggtggagtcggggggaggcctggtacagcctggggggtccctgagactctcctgtgcagcctctggattcacctttagcaactatggcatgagttgggtccgccagtctcctgggaagggctggagtgggtctcaagtgttggtggtatgggtgataatccatactacgctgactccgtgaagggccggttcaccatctccagagacaattccaagaacacggtgaatctgcaaatcaacagcctgagagtcgaggacacggccgtgtattactgtgcgaaagacatgtccgaacacggtggctggtacaatgt

SEQ ID NO: 446393 - DNA, 482 bp, Homo sapiens; identical to SEQ ID NO: 444503
  misc_feature: HEFZJCU01EXMFP.7.10.A10.1.454.heavy.3.raw

SEQ ID NO: 446394 - DNA, 537 bp, Homo sapiens
  misc_feature: HEFZJCU01AT736.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctcggcaccctcctccaagagcacctctgggggcacagcc

SEQ ID NO: 446395 - DNA, 506 bp, Homo sapiens
  misc_feature: HEFZJCU01DVV07.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggcctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 446396 - DNA, 387 bp, Homo sapiens; identical to SEQ ID NO: 445229
  misc_feature: HEFZJCU01AR34C.11.20.B09.1.454.heavy.3.raw

SEQ ID NO: 446397 - DNA, 502 bp, Homo sapiens; identical to SEQ ID NO: 444768
  misc_feature: HEFZJCU01CXAWO.21.70.G04.1.454.heavy.3.raw

SEQ ID NO: 446398 - DNA, 529 bp, Homo sapiens
  misc_feature: HEFZJCU01DLLHM.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaaattccaggaacacattgtatcttcaaatgaataacctgagagccgaggacacggccatgtattactgtgtggggcatttacttgaccctggggccggggaaccctggtcaccgtctccccaccctccaccg

SEQ ID NO: 446399 - DNA, 523 bp, Homo sapiens
  misc_feature: HEFZJCU01EM27O.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccaccctccaccaagggcccatcggtcttcccctggcaccctcctccaagagcacctctgggggcacagcggccctgggctgcctggtcaaggactacttcccatactcgta

SEQ ID NO: 446400 - DNA, 490 bp, Homo sapiens
  misc_feature: HEFZJCU01CZ9VU.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaaggcccatcggtcttcccctggcaccctcctccaagagcacctctgggggcacagcggccctgggctgcctggtcaaggactacttccgagtgcgtct

SEQ ID NO: 446401 - DNA, 524 bp, Homo sapiens
  misc_feature: HEFZJCU01EHKKN.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgt

SEQ ID NO: 446402 - DNA, 514 bp, Homo sapiens
  misc_feature: HEFZJCU01DR6YB.4.67.G01.1.454.heavy.3.raw
  modified_base (475)..(475): a, c, t, g, unknown or other
  modified_base (486)..(486): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagtaatgtctgccatgacctgggtccgccaggctcctggggaaggggcgtggagtggatctcagggattagtggcactggcgattatacatattatacagactccgtgaagggccgcttcaccatctccagagacaattccaagaacacggtgtatctgcaaatgaacagcctgagagccgaggacacggccacatattacngtgacgaaagntcgtcgggctggttccgcggtccgggta

SEQ ID NO: 446403 - DNA, 528 bp, Homo sapiens
  misc_feature: HEFZJCU01CN3PB.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctaattactttgggagcacctactacaacccgtcctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccaggggaaccctggtcaccgtctcctcagcctccaccg

SEQ ID NO: 446404 - DNA, 506 bp, Homo sapiens; identical to SEQ ID NO: 444732
  misc_feature: HEFZJCU01DUT08.14.78.H01.1.454.heavy.3.raw

SEQ ID NO: 446405 - DNA, 436 bp, Homo sapiens
  misc_feature: HEFZJCU01DUAVY.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagtttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 446406 - DNA, 310 bp, Homo sapiens
  misc_feature: HEFZJCU01C09Y2.22.28.C06.1.454.heavy.3.raw
acatacgcgtcacgaccggtgctcgatttagagctcacgtattgggtttggggaagtagtccaagaaccagacttccctgagactgacctctgtgaccgccgcagacacggccgtgtatttctgtgtcggtacgagtgtccatgacagtcacaaacaactggtctcctggggccagggaaccctggtcaccgtctcctcagcctccaccaagggcccatcggtcttccccctggcaccctcctccaagagcacctctgggggcacagcggccctgggctgcctggtcaaggactacttccagacgtatca

SEQ ID NO: 446407 - DNA, 495 bp, Homo sapiens
  misc_feature: HEFZJCU01C2MRK.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgttattactgtgggagaaatcctagtggca

SEQ ID NO: 446408 - DNA, 524 bp, Homo sapiens
  misc_feature: HEFZJCU01ESZ8E.10.85.H08.1.454.heavy.3.raw
catagtagtgcacgaccggtgctcgatttagtatcactcagtcgcgggtcccacctttggttttggagatggttttctcgatgggggctgggaggcctggtccagccggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttcccactactat

SEQ ID NO: 446409 - DNA, 496 bp, Homo sapiens
  misc_feature: HEFZJCU01ET8E3.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccagagcacctccgagagcacagcggccctgggctgcctggtcaaggactacc

SEQ ID NO: 446410 - DNA, 313 bp, Homo sapiens; identical to SEQ ID NO: 445488
  misc_feature: HEFZJCU01AVQ5J.49.8.A08.1.454.heavy.3.raw

SEQ ID NO: 446411 - DNA, 499 bp, Homo sapiens
  misc_feature: HEFZJCU01CXKJL.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatgcttttgatatgtggggaccg

SEQ ID NO: 446412 - DNA, 518 bp, Homo sapiens; identical to SEQ ID NO: 444718
  misc_feature: HEFZJCU01ED1N8.9.34.D01.1.454.heavy.3.raw

SEQ ID NO: 446413 - DNA, 396 bp, Homo sapiens; identical to SEQ ID NO: 444469
  misc_feature: HEFZJCU01A2RIE.47.46.E02.1.454.heavy.3.raw

SEQ ID NO: 446414 - DNA, 488 bp, Homo sapiens; identical to SEQ ID NO: 444617
  misc_feature: HEFZJCU01DDVGI.4.6.A06.1.454.heavy.3.raw

SEQ ID NO: 446415 - DNA, 505 bp, Homo sapiens
  misc_feature: HEFZJCU01CPW1L.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggatttg

SEQ ID NO: 446416 - DNA, 392 bp, Homo sapiens; identical to SEQ ID NO: 444626
  misc_feature: HEFZJCU01B4Q03.49.46.E02.1.454.heavy.3.raw

SEQ ID NO: 446417 - DNA, 483 bp, Homo sapiens; identical to SEQ ID NO: 444924
  misc_feature: HEFZJCU01BQNFM.10.35.D02.1.454.heavy.3.raw

SEQ ID NO: 446418 - DNA, 524 bp, Homo sapiens
  misc_feature: HEFZJCU01EPS68.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 446419 - DNA, 477 bp, Homo sapiens; identical to SEQ ID NO: 444659
  misc_feature: HEFZJCU01EPNZ3.16.10.A10.1.454.heavy.3.raw

SEQ ID NO: 446420 - DNA, 354 bp, Homo sapiens
  misc_feature: HEFZJCU01E1XZW.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtaaggactacttcctacgtgagct

SEQ ID NO: 446421 - DNA, 519 bp, Homo sapiens; identical to SEQ ID NO: 444867
  misc_feature: HEFZJCU01B4N21.9.34.D01.1.454.heavy.3.raw

SEQ ID NO: 446422 - DNA, 501 bp, Homo sapiens
  misc_feature: HEFZJCU01DIJV8.48.53.E09.1.454.heavy.3.raw
agtatacatacacgaccggtgctcgatttagagagagtgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 446423 - DNA, 395 bp, Homo sapiens
  misc_feature: HEFZJCU01AU0EO.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactactcctacgtgagct

SEQ ID NO: 446424 - DNA, 512 bp, Homo sapiens
  misc_feature: HEFZJCU01EGZ4M.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttcccctggcgccctgctccaggagcacctccgagagcacagcggccctgggctgcctggtcaaggacta

SEQ ID NO: 446425 - DNA, 508 bp, Homo sapiens; identical to SEQ ID NO: 445118
  misc_feature: HEFZJCU01EKP93.18.39.D06.1.454.heavy.3.raw

SEQ ID NO: 446426 - DNA, 403 bp, Homo sapiens
  misc_feature: HEFZJCU01C0BC1.51.41.D08.1.454.heavy.3.raw
cgatcgtatacacgaccggtgctcgatttagtcacgcgagaaagggaaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 446427 - DNA, 519 bp, Homo sapiens
  misc_feature: HEFZJCU01DXAK8.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgacgagcacagcggcctgggctgcctggtcaggactactctaccg

SEQ ID NO: 446428 - DNA, 509 bp, Homo sapiens
  misc_feature: HEFZJCU01C79K3.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtatttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagagggcgaggacacggccgtgtattattgtgcgcgagatgatagtagactctacagtagcaggtgta

SEQ ID NO: 446429 - DNA, 519 bp, Homo sapiens
  misc_feature: HEFZJCU01EXSWS.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgatctggtggggcctggca

SEQ ID NO: 446430 - DNA, 497 bp, Homo sapiens
  misc_feature: HEFZJCU01BNWD9.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 446431 - DNA, 484 bp, Homo sapiens; identical to SEQ ID NO: 445876
  misc_feature: HEFZJCU01EIVY0.8.39.D06.1.454.heavy.3.raw

SEQ ID NO: 446432 - DNA, 515 bp, Homo sapiens
  misc_feature: HEFZJCU01CJ8JZ.48.19.B08.1.454.heavy.3.raw
agtatacatacacgaccggtgctcgatttagtgagtcagtaaggggggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgagctggttcgactgctggggccagggaaccctggtcaccgtctcctcagcctccaccaac

SEQ ID NO: 446433 - DNA, 521 bp, Homo sapiens
  misc_feature: HEFZJCU01CLN1N.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtcggggctgggactaccggtcgacgacccctaggaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaagggccc

SEQ ID NO: 446434 - DNA, 497 bp, Homo sapiens; identical to SEQ ID NO: 445179
  misc_feature: HEFZJCU01CDHJW.12.55.E11.1.454.heavy.3.raw

SEQ ID NO: 446435 - DNA, 379 bp, Homo sapiens; identical to SEQ ID NO: 444450
  misc_feature: HEFZJCU01A44I0.47.77.G11.1.454.heavy.3.raw

SEQ ID NO: 446436 - DNA, 514 bp, Homo sapiens
  misc_feature: HEFZJCU01D4J8G.12.71.G05.1.454.heavy.3.raw
  modified_base (462)..(462): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttcccctgcgcctgctccagngcacctccgagagcacagcgccctgggctgcctggtcaggactactcctacg

SEQ ID NO: 446437 - DNA, 516 bp, Homo sapiens
  misc_feature: HEFZJCU01CMORP.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaagggcctggagtggcttgctctcatttactgggatactgatgaccgctacactccagctctgaaaaacaggctcaccatcgccatggacacctccaaaaacaggtggtaccttaaaatgaccaacatggacccaatggacagcgcgacatattactgtgcacacattgattgtggtcccaccaggtgtcccgggtccctttgatatcgtgggggccgggggacagttcgtcaccgtctctgcagcctccaccaacgggccacg

SEQ ID NO: 446438 - DNA, 484 bp, Homo sapiens
  misc_feature: HEFZJCU01CGY9C.14.13.B02.1.454.heavy.3.raw
cgtctagtaccacgaccggtgctcgatttagtctagcgactttgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactattggggccagggaaccctggtcaccgtctcctcagcctccaccaagggcccatcggtcttcccctggcgccctgctccaggagcacctccgagagcacagcggcctgggctgcctggtcaaggactacttccgtactagacg

SEQ ID NO: 446439 - DNA, 500 bp, Homo sapiens
  misc_feature: HEFZJCU01BO2FP.49.80.H03.1.454.heavy.3.raw
agtcgagagacacgaccggtgctcgatttagctgtgcgtcgaaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggcctgggctgcctgtcaaggactacttcctct

SEQ ID NO: 446440 - DNA, 491 bp, Homo sapiens; identical to SEQ ID NO: 445333
  misc_feature: HEFZJCU01BY5TX.19.53.E09.1.454.heavy.3.raw

SEQ ID NO: 446441 - DNA, 525 bp, Homo sapiens
  misc_feature: HEFZJCU01B4VLZ.3.55.E11.1.454.heavy.3.raw
agacgcactccacgaccggtgctcgatttagcactcgcacgttgggtttgggctgagcgtgggttttccgtcgttaggctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggcaccctcctccaagacg

SEQ ID NO: 446442 - DNA, 509 bp, Homo sapiens
  misc_feature: HEFZJCU01BOSWZ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgtaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccg

SEQ ID NO: 446443 - DNA, 423 bp, Homo sapiens; identical to SEQ ID NO: 444772
  misc_feature: HEFZJCU01AN86U.16.78.H01.1.454.heavy.3.raw

SEQ ID NO: 446444 - DNA, 391 bp, Homo sapiens
  misc_feature: HEFZJCU01CVYRM.19.79.H02.1.454.heavy.3.raw
tactctcgtgcacgaccggtgctcgatttagtgtcacacgaagggaaggggctggagtgggtgtcaacgattagtggaagtggtactggtatatactacgcagactccgtgaagggccggttcaccctctccagagacaattccaagaatacggtgtatctgcaaatgaacagcctgagagccgaggacacggccgtatattactgtgcgaatcaaaagttcgggacgtccgattcgatatggacgtctggggccaagggaccacggtcaccgtctcctcagcctccaccaagggcccatcggtcttccccctggcgccctgctccaggagcacctccgagagcacagcggccctgggctgcctggtcaaggactacttcccacgagagta

SEQ ID NO: 446445 - DNA, 518 bp, Homo sapiens
  misc_feature: HEFZJCU01AMULN.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgtactcggtcgggggaataccgttcagcacgtc

SEQ ID NO: 446446 - DNA, 506 bp, Homo sapiens
  misc_feature: HEFZJCU01BTV21.48.20.B09.1.454.heavy.3.raw
agtatacatacacgaccggtgctcgatttagtgtagtgtgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 446447 - DNA, 400 bp, Homo sapiens; identical to SEQ ID NO: 444452
  misc_feature: HEFZJCU01CXM9L.47.24.C02.1.454.heavy.3.raw

SEQ ID NO: 446448 - DNA, 518 bp, Homo sapiens; identical to SEQ ID NO: 444718
  misc_feature: HEFZJCU01AZUQS.9.34.D01.1.454.heavy.3.raw

SEQ ID NO: 446449 - DNA, 352 bp, Homo sapiens; identical to SEQ ID NO: 444485
  misc_feature: HEFZJCU01EZ3UU.10.38.D05.1.454.heavy.3.raw

SEQ ID NO: 446450 - DNA, 495 bp, Homo sapiens
  misc_feature: HEFZJCU01CR6X7.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactactccgagtagtaca

SEQ ID NO: 446451 - DNA, 521 bp, Homo sapiens; identical to SEQ ID NO: 445358
  misc_feature: HEFZJCU01D8MCE.12.71.G05.1.454.heavy.3.raw

SEQ ID NO: 446452 - DNA, 513 bp, Homo sapiens
  misc_feature: HEFZJCU01DSW5B.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggccc

SEQ ID NO: 446453 - DNA, 481 bp, Homo sapiens
  misc_feature: HEFZJCU01EW0HA.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccaggggaaccctgtcaccgtctcctcagcctccaccaaggcccatcggtcttcccctggcaccctcctccaagagcacctctgggggcacagcggccctgggctgcctggtcaaggactacttcctagagacacg

SEQ ID NO: 446454 - DNA, 372 bp, Homo sapiens
  misc_feature: HEFZJCU01ERFVC.49.77.G11.1.454.heavy.3.raw
agtcgagagacacgaccggtgctcgatttagctagtcactcaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgat

SEQ ID NO: 446455 - DNA, 413 bp, Homo sapiens
  misc_feature: HEFZJCU01CSESQ.13.25.C03.1.454.heavy.3.raw
tcacgtactacacgaccggtgctcgatttagtagtgtagatttgggtttgggtgcgccaggcccctggacaaggccttgagtggatgggatggatgaaccctgagagtggtaacacaggctatgcacagaagttccagggcagactcaccatgacctgggacacctccataagcacagcctacatggagctgagcagcctgcgatctgaggacacggccatgtattactgtgcgagatttcaaaggaattacctgccgtacatggacgtctggggcgaggggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 446456 - DNA, 498 bp, Homo sapiens
  misc_feature: HEFZJCU01CAWPW.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtgaccgaactacgggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 446457 - DNA, 465 bp, Homo sapiens
  misc_feature: HEFZJCU01CHZ28.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttccccctggcgccctgctccaggagcacctccgacgagcacagcggccctgggctgcctggtcaaggactattcccacgacgagta

SEQ ID NO: 446458 - DNA, 467 bp, Homo sapiens; identical to SEQ ID NO: 445004
  misc_feature: HEFZJCU01D1XJ0.16.78.H01.1.454.heavy.3.raw

SEQ ID NO: 446459 - DNA, 482 bp, Homo sapiens
  misc_feature: HEFZJCU01CU1E9.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctggctgcctggtcaaggactacttcccactactatg

SEQ ID NO: 446460 - DNA, 370 bp, Homo sapiens
  misc_feature: HEFZJCU01DSZ16.14.77.G11.1.454.heavy.3.raw
cgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 446461 - DNA, 396 bp, Homo sapiens; identical to SEQ ID NO: 444469
  misc_feature: HEFZJCU01C7Y1Y.47.46.E02.1.454.heavy.3.raw

SEQ ID NO: 446462 - DNA, 471 bp, Homo sapiens; identical to SEQ ID NO: 444988
  misc_feature: HEFZJCU01CZK0L.48.1.A01.1.454.heavy.3.raw

SEQ ID NO: 446463 - DNA, 480 bp, Homo sapiens; identical to SEQ ID NO: 444947
  misc_feature: HEFZJCU01AWOG5.22.36.D03.1.454.heavy.3.raw

SEQ ID NO: 446464 - DNA, 508 bp, Homo sapiens; identical to SEQ ID NO: 445594
  misc_feature: HEFZJCU01CNS2Z.17.25.C03.1.454.heavy.3.raw

SEQ ID NO: 446465 - DNA, 308 bp, Homo sapiens
  misc_feature: HEFZJCU01CW6OA.49.67.G01.1.454.heavy.3.raw
agtcgagagacacgaccggtgctcgatttagagtatacatattgggtttggggggaagaggaagactgacggtcctcccaggagttcaggtgctgggcaccgtgggcatgggggaggtgtgtcacaagatttgggctctgggcaccgtgggcatggggaggtgtgtcacaagatttgagccctggtcaccgtctcctcagcttccaccaagggcccatcggtcttccccctggcgccctgctccaggagcacctctggggcacagcggccctgggctgcctggtcaaggactacttcctctctcgact

SEQ ID NO: 446466 - DNA, 500 bp, Homo sapiens; identical to SEQ ID NO: 444529
  misc_feature: HEFZJCU01DESUP.12.38.D05.1.454.heavy.3.raw

SEQ ID NO: 446467 - DNA, 533 bp, Homo sapiens
  misc_feature: HEFZJCU01EATE1.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctgggccagggaaccctggtcagcgtctcttcagcctccaccaagggcccatcggtcttcccctggcaccctcctccagagcacctctgggggcacagcggccctgggctg

SEQ ID NO: 446468 - DNA, 525 bp, Homo sapiens
  misc_feature: HEFZJCU01EMUGR.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactgggccagggcaccctggtcaccgtctcctcagcctccaccaagggcccatcggtcttcccctggcaccctcctccaagagcacctctgggggcacgagcggccctggggctgcctc

SEQ ID NO: 446469 - DNA, 536 bp, Homo sapiens
  misc_feature: HEFZJCU01C964U.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagctattgtcggacgtacgttacggttttgattaggtttcggggaccgaaggggaacgtaagggtcctaccggtcctccgcacgccct

SEQ ID NO: 446470 - DNA, 491 bp, Homo sapiens; identical to SEQ ID NO: 444803
  misc_feature: HEFZJCU01D4A90.4.57.F02.1.454.heavy.3.raw

SEQ ID NO: 446471 - DNA, 517 bp, Homo sapiens
  misc_feature: HEFZJCU01AV8SS.52.53.E09.1.454.heavy.3.raw
cgcagtacgacacgaccggtgctcgatttagagagagtgtgttgggtttgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaacttctggggccagggaccc

SEQ ID NO: 446472 - DNA, 515 bp, Homo sapiens
  misc_feature: HEFZJCU01CPJZ9.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacgagcc

SEQ ID NO: 446473 - DNA, 505 bp, Homo sapiens
  misc_feature: HEFZJCU01CO39Y.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggcctgggctgcctggtcaaggactacttcctagtacgtga

SEQ ID NO: 446474 - DNA, 502 bp, Homo sapiens
  misc_feature: HEFZJCU01BCYC3.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcatcctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggctacttcccacta

SEQ ID NO: 446475 - DNA, 527 bp, Homo sapiens
  misc_feature: HEFZJCU01CVS3K.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcgttgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttcccctggcaccctcctccagagcacctctgggggcacagcggccctgggctgcctggtcaaggactacttccg

SEQ ID NO: 446476 - DNA, 500 bp, Homo sapiens; identical to SEQ ID NO: 444529
  misc_feature: HEFZJCU01BA8WT.12.38.D05.1.454.heavy.3.raw

SEQ ID NO: 446477 - DNA, 497 bp, Homo sapiens; identical to SEQ ID NO: 445179
  misc_feature: HEFZJCU01DOLQ7.12.55.E11.1.454.heavy.3.raw

SEQ ID NO: 446478 - DNA, 400 bp, Homo sapiens; identical to SEQ ID NO: 444452
  misc_feature: HEFZJCU01EF3YO.47.24.C02.1.454.heavy.3.raw

SEQ ID NO: 446479 - DNA, 499 bp, Homo sapiens
  misc_feature: HEFZJCU01BT1V8.40.75.G09.1.454.heavy.3.raw
tctagcgactcacgaccggtgctcgatttagtatagacatcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctc

SEQ ID NO: 446480 - DNA, 529 bp, Homo sapiens
  misc_feature: HEFZJCU01AN51N.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccg

SEQ ID NO: 446481 - DNA, 372 bp, Homo sapiens
  misc_feature: HEFZJCU01EUM3Q.49.70.G04.1.454.heavy.3.raw
agtcgagagacacgaccggtgctcgatttagtgtagtgtgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcgcctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 446482 - DNA, 339 bp, Homo sapiens; identical to SEQ ID NO: 444436
  misc_feature: HEFZJCU01CD9MA.47.38.D05.1.454.heavy.3.raw

SEQ ID NO: 446483 - DNA, 518 bp, Homo sapiens
  misc_feature: HEFZJCU01CTDAO.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtccttcccctggcaccctcctccaagagcacctctgggggcacagcggccctgggctgcctggtcaaggactacttccgagtagtaca

SEQ ID NO: 446484 - DNA, 538 bp, Homo sapiens
  misc_feature: HEFZJCU01CSSV3.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacgggctgtctattactgtgcgagaggccccttagtttcggtttttggactggttctcccatggaatccctactttgagtactggggccgcggagccctggtcaccgtctcctcagcctccaccaaggcccatcggtcttcccctggcaccct

SEQ ID NO: 446485 - DNA, 482 bp, Homo sapiens; identical to SEQ ID NO: 445520
  misc_feature: HEFZJCU01CQYTQ.10.35.D02.1.454.heavy.3.raw

SEQ ID NO: 446486 - DNA, 519 bp, Homo sapiens
  misc_feature: HEFZJCU01EIF15.13.4.A04.1.454.heavy.3.raw
tcacgtactacacgaccggtgctcgatttagagtagtgatcagggggagagaggagcccagccctgggattttcaggtgttttcatttggtgatcaggactgaacagagagaactcaccatggaatttgggctgagcgtggcgttttcttaggtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactctggggccagggaaccctggt

SEQ ID NO: 446487 - DNA, 519 bp, Homo sapiens
  misc_feature: HEFZJCU01D3SQA.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaacctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 446488 - DNA, 400 bp, Homo sapiens; identical to SEQ ID NO: 444452
  misc_feature: HEFZJCU01EQU1G.47.24.C02.1.454.heavy.3.raw

SEQ ID NO: 446489 - DNA, 511 bp, Homo sapiens; identical to SEQ ID NO: 446351
  misc_feature: HEFZJCU01CCXIH.18.39.D06.1.454.heavy.3.raw

SEQ ID NO: 446490 - DNA, 396 bp, Homo sapiens; identical to SEQ ID NO: 444469
  misc_feature: HEFZJCU01DHTX4.47.46.E02.1.454.heavy.3.raw

SEQ ID NO: 446491 - DNA, 518 bp, Homo sapiens; identical to SEQ ID NO: 444718
  misc_feature: HEFZJCU01ECNVZ.9.34.D01.1.454.heavy.3.raw

SEQ ID NO: 446492 - DNA, 422 bp, Homo sapiens; identical to SEQ ID NO: 444681
  misc_feature: HEFZJCU01DN7AZ.16.78.H01.1.454.heavy.3.raw

SEQ ID NO: 446493 - DNA, 499 bp, Homo sapiens
  misc_feature: HEFZJCU01CM644.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaggactacttcctacgtcgtat

SEQ ID NO: 446494 - DNA, 490 bp, Homo sapiens
  misc_feature: HEFZJCU01BXD1X.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactacttccgtatctctcg

SEQ ID NO: 446495 - DNA, 522 bp, Homo sapiens
  misc_feature: HEFZJCU01EGFMZ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggccaccctcctccaagagcacctcgtgggggcacagcggccctgggctgcctggtcaaggactacttcctagagacacg

SEQ ID NO: 446496 - DNA, 373 bp, Homo sapiens
  misc_feature: HEFZJCU01DWG5N.49.81.H04.1.454.heavy.3.raw
agtcgagagacacgaccggtgctcgatttagtagtgtagattcgcggggtagtgtagattcgcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgaccccatcggtcttccccctggcaccctcctccaagagcacctctgggggcacagcggccctgggctgcctggtcaaggactacttcctctctcgact

SEQ ID NO: 446497 - DNA, 512 bp, Homo sapiens
  misc_feature: HEFZJCU01ECNIF.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaaggcccatcggtcttcccctggca

SEQ ID NO: 446498 - DNA, 526 bp, Homo sapiens
  misc_feature: HEFZJCU01CEJ5M.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaaggcccatcggtcttcccctggcaccctcctccagagcacctctgggggcacagcggccctgggctg

SEQ ID NO: 446499 - DNA, 393 bp, Homo sapiens
  misc_feature: HEFZJCU01EF0DR.49.70.G04.1.454.heavy.3.raw
agtcgagagacacgaccggtgctcgatttagtgtagtgtgaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446500 - DNA, 481 bp, Homo sapiens
  misc_feature: HEFZJCU01C7JVF.40.83.H06.1.454.heavy.3.raw
  modified_base (351)..(351): a, c, t, g, unknown or other
tctagcgactcacgaccggtgctcgatttagatcacgtgcgtcgcggggtgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctgggtcggatgaaagttntgcatactatgcagactctctgaggggccgattcatcatctctagagacaattcgaagaacacggcttatctgcaaatgaacagcctgacagtcgaggacacggctgtatatttctgtgcgaatgaggaa

SEQ ID NO: 446501 - DNA, 394 bp, Homo sapiens
  misc_feature: HEFZJCU01B4RBO.49.62.F07.1.454.heavy.3.raw
agtcgagagacacgaccggtgctcgatttagtagtcgcataaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtttggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446502 - DNA, 512 bp, Homo sapiens; identical to SEQ ID NO: 445688
  misc_feature: HEFZJCU01BRPJ6.3.34.D01.1.454.heavy.3.raw

SEQ ID NO: 446503 - DNA, 517 bp, Homo sapiens
  misc_feature: HEFZJCU01BO1P7.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcgccctgggctgcctggtcaaggactacttccagacgtatca

SEQ ID NO: 446504 - DNA, 395 bp, Homo sapiens; identical to SEQ ID NO: 444517
  misc_feature: HEFZJCU01CGYGS.16.68.G02.1.454.heavy.3.raw

SEQ ID NO: 446505 - DNA, 379 bp, Homo sapiens; identical to SEQ ID NO: 444450
  misc_feature: HEFZJCU01DMC8P.47.77.G11.1.454.heavy.3.raw

SEQ ID NO: 446506 - DNA, 518 bp, Homo sapiens; identical to SEQ ID NO: 444718
  misc_feature: HEFZJCU01CAWW1.9.34.D01.1.454.heavy.3.raw

SEQ ID NO: 446507 - DNA, 384 bp, Homo sapiens; identical to SEQ ID NO: 444454
  misc_feature: HEFZJCU01B56QQ.11.61.F06.1.454.heavy.3.raw

SEQ ID NO: 446508 - DNA, 516 bp, Homo sapiens; identical to SEQ ID NO: 444848
  misc_feature: HEFZJCU01CDZC1.9.34.D01.1.454.heavy.3.raw

SEQ ID NO: 446509 - DNA, 521 bp, Homo sapiens; identical to SEQ ID NO: 445317
  misc_feature: HEFZJCU01A4EFL.12.40.D07.1.454.heavy.3.raw

SEQ ID NO: 446510 - DNA, 424 bp, Homo sapiens; identical to SEQ ID NO: 446223
  misc_feature: HEFZJCU01CCTXD.51.41.D08.1.454.heavy.3.raw

SEQ ID NO: 446511 - DNA, 497 bp, Homo sapiens
  misc_feature: HEFZJCU01BFE47.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 446512 - DNA, 324 bp, Homo sapiens; identical to SEQ ID NO: 444475
  misc_feature: HEFZJCU01BRW07.18.17.B06.1.454.heavy.3.raw

SEQ ID NO: 446513 - DNA, 396 bp, Homo sapiens; identical to SEQ ID NO: 444469
  misc_feature: HEFZJCU01AVE1U.47.46.E02.1.454.heavy.3.raw

SEQ ID NO: 446514 - DNA, 436 bp, Homo sapiens
  misc_feature: HEFZJCU01DW7BK.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaagactacttccgagtgcgtct

SEQ ID NO: 446515 - DNA, 500 bp, Homo sapiens
  misc_feature: HEFZJCU01EKZXL.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggcccttttattactgtgcgagatttaccgtgggggtcacggcggatatatcgccata

SEQ ID NO: 446516 - DNA, 514 bp, Homo sapiens
  misc_feature: HEFZJCU01ATVHF.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggcccg

SEQ ID NO: 446517 - DNA, 494 bp, Homo sapiens
  misc_feature: HEFZJCU01DHNI2.51.1.A01.1.454.heavy.3.raw
cgatcgtatacacgaccggtgctcgatttagacgtctcatcagggggggagaggagcccagcactagaagtcggcggtgtttccattcggtgatcagcactgaacacagaggactcaccatggagtttgggctgagcgtggtttccgtcgttaggctctttaagtaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattatgtgcgaacttaatcacggagacaacggtccg

SEQ ID NO: 446518 - DNA, 324 bp, Homo sapiens; identical to SEQ ID NO: 444475
  misc_feature: HEFZJCU01DPLAI.18.17.B06.1.454.heavy.3.raw

SEQ ID NO: 446519 - DNA, 404 bp, Homo sapiens
  misc_feature: HEFZJCU01BG3OO.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggagcacctccgagagcacagcggccctgggctgcctggtcaaggactacttccagtgcgtct

SEQ ID NO: 446520 - DNA, 506 bp, Homo sapiens
  misc_feature: HEFZJCU01AQS30.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 446521 - DNA, 522 bp, Homo sapiens
  misc_feature: HEFZJCU01CYTOS.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggttttccttcactattactcccactactacggtttggacgtctggggccaagggaccacggtcaccgtctcctcagcctccaccaaggcccatcggtcttcccctggcaccctcctccaagagcacctctgggggcacagcggccctgggctgcctggtcaaggactacttcctcgtactgcg

SEQ ID NO: 446522 - DNA, 390 bp, Homo sapiens; identical to SEQ ID NO: 444541
  misc_feature: HEFZJCU01BLASF.16.24.C02.1.454.heavy.3.raw

SEQ ID NO: 446523 - DNA, 509 bp, Homo sapiens; identical to SEQ ID NO: 444586
  misc_feature: HEFZJCU01DKGUI.12.78.H01.1.454.heavy.3.raw

SEQ ID NO: 446524 - DNA, 491 bp, Homo sapiens
  misc_feature: HEFZJCU01CE64X.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggccgccctgctccaggagcacctccgagagcacagcggccctgggctgcctggtcaaggactacttcccacgagagta

SEQ ID NO: 446525 - DNA, 387 bp, Homo sapiens; identical to SEQ ID NO: 444818
  misc_feature: HEFZJCU01EMUPQ.11.79.H02.1.454.heavy.3.raw

SEQ ID NO: 446526 - DNA, 506 bp, Homo sapiens
  misc_feature: HEFZJCU01AL1WP.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgtaccttttctggttatttcgatctctggggccgtggcaccctggtcactgtctcctcggcttccaccaaggccatcggtcttcccctggcgccctcgctccaggagcacctctgggggcac

SEQ ID NO: 446527 - DNA, 415 bp, Homo sapiens; identical to SEQ ID NO: 444794
  misc_feature: HEFZJCU01EQFYH.14.74.G08.1.454.heavy.3.raw

SEQ ID NO: 446528 - DNA, 501 bp, Homo sapiens
  misc_feature: HEFZJCU01DG4HR.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctacaaaagtcgaggcaccatatccgtagacacgtccaagaaccaattctccctgaagctgagctctgtgaccgccgcagacacggctgtctattactgtgcgaggccccgagcgcagtggctttttgatgtcctttgatatgtgggccaagggacaagtggtc

SEQ ID NO: 446529 - DNA, 392 bp, Homo sapiens
  misc_feature: HEFZJCU01CZVIQ.12.22.B11.1.454.heavy.3.raw
atacgacgtacacgaccggtgctcgatttagacgacagctcagggaaggccctggagtggataggatacatctctaaaagtgggagtaccttctacaatccgtcactcaagagtcgagtttccatatccgtagacatgaccaagaatcacttctccctgaacctgacctctatgactgtcgcagacacggccgtctattactgtggcagagaaagatatatagcggcggtccatctatacatagacgtctggggcaaagggaccacggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 446530 - DNA, 395 bp, Homo sapiens; identical to SEQ ID NO: 445227
  misc_feature: HEFZJCU01BATU4.47.46.E02.1.454.heavy.3.raw

SEQ ID NO: 446531 - DNA, 518 bp, Homo sapiens; identical to SEQ ID NO: 445810
  misc_feature: HEFZJCU01C5PS3.2.11.A11.1.454.heavy.3.raw

SEQ ID NO: 446532 - DNA, 501 bp, Homo sapiens; identical to SEQ ID NO: 445341
  misc_feature: HEFZJCU01DSKMQ.48.34.D01.1.454.heavy.3.raw

SEQ ID NO: 446533 - DNA, 480 bp, Homo sapiens
  misc_feature: HEFZJCU01EXQRN.9.36.D03.1.454.heavy.3.raw
tgatacgtctcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatca

SEQ ID NO: 446534 - DNA, 466 bp, Homo sapiens; identical to SEQ ID NO: 445835
  misc_feature: HEFZJCU01A591B.9.34.D01.1.454.heavy.3.raw

SEQ ID NO: 446535 - DNA, 312 bp, Homo sapiens; identical to SEQ ID NO: 444415
  misc_feature: HEFZJCU01D90LQ.7.10.A10.1.454.heavy.3.raw

SEQ ID NO: 446536 - DNA, 375 bp, Homo sapiens; identical to SEQ ID NO: 446168
  misc_feature: HEFZJCU01C6UC3.13.78.H01.1.454.heavy.3.raw

SEQ ID NO: 446537 - DNA, 460 bp, Homo sapiens; identical to SEQ ID NO: 444688
  misc_feature: HEFZJCU01BP551.53.12.B01.1.454.heavy.3.raw

SEQ ID NO: 446538 - DNA, 491 bp, Homo sapiens; identical to SEQ ID NO: 444592
  misc_feature: HEFZJCU01D4Z8A.11.26.C04.1.454.heavy.3.raw

SEQ ID NO: 446539 - DNA, 515 bp, Homo sapiens
  misc_feature: HEFZJCU01DXNJV.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtggtttcgtgtaggctatataaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgcctggttattta

SEQ ID NO: 446540 - DNA, 483 bp, Homo sapiens; identical to SEQ ID NO: 444924
  misc_feature: HEFZJCU01CLA35.10.35.D02.1.454.heavy.3.raw

SEQ ID NO: 446541 - DNA, 491 bp, Homo sapiens; identical to SEQ ID NO: 445531
  misc_feature: HEFZJCU01ARKZ5.11.38.D05.1.454.heavy.3.raw

SEQ ID NO: 446542 - DNA, 528 bp, Homo sapiens
  misc_feature: HEFZJCU01EXDNC.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccagggaaccctggtcaccgtctcctcagcctccaccg

SEQ ID NO: 446543 - DNA, 514 bp, Homo sapiens
  misc_feature: HEFZJCU01D070J.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaactatgcggactctgtgaagggccgattcaccatttccagagacaacgccaagaagtcactctctctacacatgaccagcctgacagccgaggacacggctgtttattactgtgcgagagatggcactcggggcggtgactttgactactggggccaggggcaccctggtcaccgtctcctcagcctccaccaagggcccatccggtcttcccctgcgccctgc

SEQ ID NO: 446544 - DNA, 517 bp, Homo sapiens
  misc_feature: HEFZJCU01BFJTJ.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttgggggccggggaacctgggtccaccgtcaac

SEQ ID NO: 446545 - DNA, 391 bp, Homo sapiens; identical to SEQ ID NO: 444514
  misc_feature: HEFZJCU01CZQ0H.12.24.C02.1.454.heavy.3.raw

SEQ ID NO: 446546 - DNA, 515 bp, Homo sapiens
  misc_feature: HEFZJCU01CJR81.26.12.B01.1.454.heavy.3.raw
  modified_base (486)..(486): a, c, t, g, unknown or other
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccaggggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaaggtggaaccganatatttcacaagctggcactggtacttcg

SEQ ID NO: 446547 - DNA, 395 bp, Homo sapiens; identical to SEQ ID NO: 444494
  misc_feature: HEFZJCU01CAPCL.47.46.E02.1.454.heavy.3.raw

SEQ ID NO: 446548 - DNA, 507 bp, Homo sapiens
  misc_feature: HEFZJCU01BSKAV.3.81.H04.1.454.heavy.3.raw
agacgcactccacgaccggtgctcgatttagtagtgtagattcgcgggctggtggagtctgggggaggcttggtccagcctgggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 446549 - DNA, 524 bp, Homo sapiens
  misc_feature: HEFZJCU01B0S99.12.71.G05.1.454.heavy.3.raw
  modified_base (467)..(467): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtcgtcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgccgggagcgtctacatatttcgacccctggggccagggaacccaggtcaccgtctcctcagcctccaccaagggcccatccgtcttcccctggcgccctgcctccagngcacctccgagagcacagcggccctgggctgcctggtcaggactacttcctacgtcg

SEQ ID NO: 446550 - DNA, 423 bp, Homo sapiens
  misc_feature: HEFZJCU01D26OX.11.22.B11.1.454.heavy.3.raw
cgagagataccacgaccggtgctcgatttagacgacagctcaagggaaggggctagagtggattggggaaatcaatgatagtggaagcaccaactacaacccgtccctcaagagccgagtcaccatatcagtagacacgtccaagaaccagttctccctgaagttgacctccgtgaccgccgcggacacggctgtgtattattgtgcgagaggggttaatggcgccttaatgatgacccgggcgcggccggtgtacaatggagggagttacatggacgtctggggcaaagggaccacagtcatcgtctccgcagcttccaccaagggcccatcggtcttccccctggcgccctgctccaggagcacctctgggggcacagcggccctgggctgcctggtcaaggactacttccgtatctctcg

SEQ ID NO: 446551 - DNA, 498 bp, Homo sapiens
  misc_feature: HEFZJCU01AHN94.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggcccatcggtcttccccctggcgccctgctccaggagcacctccgagaacacagcggccctgggctgcctggtcaaggactacttccctacagtgct

SEQ ID NO: 446552 - DNA, 488 bp, Homo sapiens
  misc_feature: HEFZJCU01BYW56.48.17.B06.1.454.heavy.3.raw
agtatacatacacgaccggtgctcgatttagtcgatagtgaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggccatcggtcttcccctggcgccctgctccaggagcacctccgagagcacagcggccctgggctgcctggtcaaggactacttcctatgtatact

SEQ ID NO: 446553 - DNA, 385 bp, Homo sapiens
  misc_feature: HEFZJCU01AT709.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 446554 - DNA, 381 bp, Homo sapiens; identical to SEQ ID NO: 445431
  misc_feature: HEFZJCU01BNA0W.3.70.G04.1.454.heavy.3.raw

SEQ ID NO: 446555 - DNA, 491 bp, Homo sapiens; identical to SEQ ID NO: 446104
  misc_feature: HEFZJCU01AK3AG.3.34.D01.1.454.heavy.3.raw

SEQ ID NO: 446556 - DNA, 495 bp, Homo sapiens
  misc_feature: HEFZJCU01D9YQV.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 446557 - DNA, 464 bp, Homo sapiens
  misc_feature: HEFZJCU01EPWVS.10.85.H08.1.454.heavy.3.raw
catagtagtgcacgaccggtgctcgatttagtatcactcagtcgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctcccgagagcacagcggccctgggctgcctggtcaaggactacttcccactactatg

SEQ ID NO: 446558 - DNA, 397 bp, Homo sapiens
  misc_feature: HEFZJCU01DP7C0.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtcgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 446559 - DNA, 489 bp, Homo sapiens; identical to SEQ ID NO: 444791
  misc_feature: HEFZJCU01DLCSH.47.85.H08.1.454.heavy.3.raw

SEQ ID NO: 446560 - DNA, 384 bp, Homo sapiens; identical to SEQ ID NO: 444454
  misc_feature: HEFZJCU01AO73W.11.61.F06.1.454.heavy.3.raw

SEQ ID NO: 446561 - DNA, 323 bp, Homo sapiens
  misc_feature: HEFZJCU01DUPHH.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctctgggggcacagcggccctgggctgcctggtcaagactacttcccatactcgta

SEQ ID NO: 446562 - DNA, 534 bp, Homo sapiens
  misc_feature: HEFZJCU01D0ITX.17.28.C06.1.454.heavy.3.raw
  modified_base (370)..(370): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtaggaaaaagtatggctgtgtttatggggccagggagccctggtccaccg

SEQ ID NO: 446563 - DNA, 400 bp, Homo sapiens
  misc_feature: HEFZJCU01BIQL1.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggcccagggctgcctggtcaaggactacttcctacgtgagct

SEQ ID NO: 446564 - DNA, 484 bp, Homo sapiens
  misc_feature: HEFZJCU01BEVPV.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaggcggt

SEQ ID NO: 446565 - DNA, 477 bp, Homo sapiens
  misc_feature: HEFZJCU01BI6O9.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacacagagtccgtgaagggccgattcaccgatctccagagacacttccgagaacacgctgtatctgcgaatgaacagcctgagagtcgaggacacggccatagtattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaggactacttccgagtagtaca

SEQ ID NO: 446566 - DNA, 384 bp, Homo sapiens; identical to SEQ ID NO: 444454
  misc_feature: HEFZJCU01EINXL.11.61.F06.1.454.heavy.3.raw

SEQ ID NO: 446567 - DNA, 393 bp, Homo sapiens; identical to SEQ ID NO: 444509
  misc_feature: HEFZJCU01CZXI1.49.46.E02.1.454.heavy.3.raw

SEQ ID NO: 446568 - DNA, 432 bp, Homo sapiens; identical to SEQ ID NO: 444920
  misc_feature: HEFZJCU01CCXP9.11.39.D06.1.454.heavy.3.raw

SEQ ID NO: 446569 - DNA, 423 bp, Homo sapiens; identical to SEQ ID NO: 446550
  misc_feature: HEFZJCU01CJSXA.11.22.B11.1.454.heavy.3.raw

SEQ ID NO: 446570 - DNA, 449 bp, Homo sapiens; identical to SEQ ID NO: 446204
  misc_feature: HEFZJCU01AQ2YL.9.53.E09.1.454.heavy.3.raw

SEQ ID NO: 446571 - DNA, 379 bp, Homo sapiens
  misc_feature: HEFZJCU01B95CK.3.59.F04.1.454.heavy.3.raw
agacgcactccacgaccggtgctcgatttagtacacacacttagggattggggtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 446572 - DNA, 509 bp, Homo sapiens
  misc_feature: HEFZJCU01ELV4Q.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggcctgggctgcctggtcaaggactacttcccata

SEQ ID NO: 446573 - DNA, 518 bp, Homo sapiens
  misc_feature: HEFZJCU01BXEHM.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggagaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 446574 - DNA, 500 bp, Homo sapiens; identical to SEQ ID NO: 445080
  misc_feature: HEFZJCU01A12J4.3.81.H04.1.454.heavy.3.raw

SEQ ID NO: 446575 - DNA, 505 bp, Homo sapiens
  misc_feature: HEFZJCU01CADD7.49.10.A10.1.454.heavy.3.raw
agtcgagagacacgaccggtgctcgatttagcgtcgatctcagggcacgaccggtgctcgatttagcgtcgatctcaggggtccgggagatcatgagggtgtccttgggttttggggggaagaggaagactgacggtccccccaggagttcaggtgctggagtgggtggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttcctaggagcgatcatactactttgtaccactggggccagggaaccctggtcaccgtctcctcagcctccaccaagggcccatcggtcttcccctcggcaccctcctccaagagcacctctgggggcacagcggccctgggctgcctggtcaaggactacttcctctctcgact

SEQ ID NO: 446576 - DNA, 498 bp, Homo sapiens
  misc_feature: HEFZJCU01EPUTO.2.86.H09.1.454.heavy.3.raw
acgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttctggggccagggaaccctggtcaccgtctcctcagcctccaccaagggcccatcggtcttccccctggcgccctgctccaggagcacctccgagagcacagcggccctgggctgcctggtcaaggactacttcctgtcgagcgt

SEQ ID NO: 446577 - DNA, 483 bp, Homo sapiens; identical to SEQ ID NO: 444532
  misc_feature: HEFZJCU01BHXP5.47.59.F04.1.454.heavy.3.raw

SEQ ID NO: 446578 - DNA, 336 bp, Homo sapiens
  misc_feature: HEFZJCU01B8SG6.3.31.C09.1.454.heavy.3.raw
agacgcactccacgaccggtgctcgatttagacgtctcatcaaggaaggaagggccgattcaccatctccagagacaaagccaagaactcactgtatctggaaatgaacagcctgagagccgaggacacggctgtgtattactgtgcgagagggcggctttggggttcaggaccgtcctacgctatggacgtctggggccaagggaccacggtcaccgtctcctcagcctccaccaagggcccatcggtcttccccctgacgccctgctccaggagcacctccgagagcacagcggccctgggctgcctggtcaaggactacttccgagtgcgtct

SEQ ID NO: 446579 - DNA, 491 bp, Homo sapiens; identical to SEQ ID NO: 445531
  misc_feature: HEFZJCU01DUOSM.11.38.D05.1.454.heavy.3.raw

SEQ ID NO: 446580 - DNA, 387 bp, Homo sapiens; identical to SEQ ID NO: 445229
  misc_feature: HEFZJCU01CEKW0.11.20.B09.1.454.heavy.3.raw

SEQ ID NO: 446581 - DNA, 508 bp, Homo sapiens
  misc_feature: HEFZJCU01EOB8X.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccaggtcaccgtctcctcagcctccaccaagggcccatcc

SEQ ID NO: 446582 - DNA, 396 bp, Homo sapiens; identical to SEQ ID NO: 444568
  misc_feature: HEFZJCU01D1VQG.47.46.E02.1.454.heavy.3.raw

SEQ ID NO: 446583 - DNA, 443 bp, Homo sapiens
  misc_feature: HEFZJCU01CE2BR.10.11.A11.1.454.heavy.3.raw
catagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagtttgaccactggggccagggcatgctagtcaccgtctccccagcctccaccaagggcccatcggtcttccccctggcaccctcctccaagagcacctctgggggcacagcggccctgggctgcctggtcaaggactacttcccactactatg

SEQ ID NO: 446584 - DNA, 543 bp, Homo sapiens
  misc_feature: HEFZJCU01C4OEI.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccaccg

SEQ ID NO: 446585 - DNA, 502 bp, Homo sapiens
  misc_feature: HEFZJCU01CNKG8.11.71.G05.1.454.heavy.3.raw
  modified_base (482)..(482): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagcggtggtttcgtcgtaggctctttaagtaggtgtcagtgtcaggtgcaactggaggagtcgtgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatgaggtnaacgtacggggggcgttccg

SEQ ID NO: 446586 - DNA, 391 bp, Homo sapiens; identical to SEQ ID NO: 444514
  misc_feature: HEFZJCU01BB6PV.12.24.C02.1.454.heavy.3.raw

SEQ ID NO: 446587 - DNA, 483 bp, Homo sapiens
  misc_feature: HEFZJCU01CA55B.40.57.F02.1.454.heavy.3.raw
tctagcgactcacgaccggtgctcgatttagctcgatatagttgggtttgggcacgaccggtgctcgatttagctcgatatagttgggtttgggctcaactctcttgtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 446588 - DNA, 506 bp, Homo sapiens
  misc_feature: HEFZJCU01DQCQO.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaagatattgtaatgatggtagctgctactacactttttgactactggggccagggaaccctggtcaccgtctcttcagcctccaccaagggcccatcggtcttccccctggcaccctcctccaagagcacctctgggggcacagcggccctgggctgcctggtcaaggactacttcctagtacgtga

SEQ ID NO: 446589 - DNA, 504 bp, Homo sapiens
  misc_feature: HEFZJCU01EEXX7.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccgattcaccatctccagagaaaatggcaagaactccttgtatcttcaaatgaacagcctgagagccggggacacggcggtgtattactgtgtaagagagctcgatggtaacgagggacttaat

SEQ ID NO: 446590 - DNA, 396 bp, Homo sapiens; identical to SEQ ID NO: 444426
  misc_feature: HEFZJCU01CNKT0.18.31.C09.1.454.heavy.3.raw

SEQ ID NO: 446591 - DNA, 449 bp, Homo sapiens; identical to SEQ ID NO: 444589
  misc_feature: HEFZJCU01BEEO1.53.57.F02.1.454.heavy.3.raw

SEQ ID NO: 446592 - DNA, 496 bp, Homo sapiens
  misc_feature: HEFZJCU01COJGE.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaaccctggtcaccgtctcctcagcctccaccg

SEQ ID NO: 446593 - DNA, 482 bp, Homo sapiens; identical to SEQ ID NO: 444503
  misc_feature: HEFZJCU01E1OGK.7.10.A10.1.454.heavy.3.raw

SEQ ID NO: 446594 - DNA, 486 bp, Homo sapiens; identical to SEQ ID NO: 444861
  misc_feature: HEFZJCU01CFTC7.47.55.E11.1.454.heavy.3.raw

SEQ ID NO: 446595 - DNA, 379 bp, Homo sapiens; identical to SEQ ID NO: 444773
  misc_feature: HEFZJCU01A5TF3.3.59.F04.1.454.heavy.3.raw

SEQ ID NO: 446596 - DNA, 493 bp, Homo sapiens
  misc_feature: HEFZJCU01CXWG9.19.1.A01.1.454.heavy.3.raw
tactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgcgacagaaagagattccatactcaggcggggcactatggcagc

SEQ ID NO: 446597 - DNA, 396 bp, Homo sapiens
  misc_feature: HEFZJCU01EDNS6.13.46.E02.1.454.heavy.3.raw
tcacgtactacacgaccggtgctcgatttagactcatctacagggaaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtga

SEQ ID NO: 446598 - DNA, 512 bp, Homo sapiens; identical to SEQ ID NO: 445688
  misc_feature: HEFZJCU01C9RDZ.3.34.D01.1.454.heavy.3.raw

SEQ ID NO: 446599 - DNA, 513 bp, Homo sapiens; identical to SEQ ID NO: 446452
  misc_feature: HEFZJCU01DG2LD.17.33.C11.1.454.heavy.3.raw

SEQ ID NO: 446600 - DNA, 496 bp, Homo sapiens
  misc_feature: HEFZJCU01CQSAV.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttccccctggcgccctgctccaggagcacctccgagagcacagcggccctgggctgcctggtcaaggactacttccctacagtgct

SEQ ID NO: 446601 - DNA, 490 bp, Homo sapiens; identical to SEQ ID NO: 444500
  misc_feature: HEFZJCU01C45C0.19.53.E09.1.454.heavy.3.raw

SEQ ID NO: 446602 - DNA, 477 bp, Homo sapiens; identical to SEQ ID NO: 444659
  misc_feature: HEFZJCU01DC0R9.16.10.A10.1.454.heavy.3.raw

SEQ ID NO: 446603 - DNA, 383 bp, Homo sapiens
  misc_feature: HEFZJCU01ACRRJ.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaggactacttccgtatctctcg

SEQ ID NO: 446604 - DNA, 384 bp, Homo sapiens; identical to SEQ ID NO: 444454
  misc_feature: HEFZJCU01ENKD8.11.61.F06.1.454.heavy.3.raw

SEQ ID NO: 446605 - DNA, 498 bp, Homo sapiens
  misc_feature: HEFZJCU01B0V67.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacc

SEQ ID NO: 446606 - DNA, 392 bp, Homo sapiens; identical to SEQ ID NO: 444682
  misc_feature: HEFZJCU01CMKNN.16.70.G04.1.454.heavy.3.raw

SEQ ID NO: 446607 - DNA, 487 bp, Homo sapiens
  misc_feature: HEFZJCU01EX5KZ.53.56.F01.1.454.heavy.3.raw
cgcgtatacacacgaccggtgctcgatttagcagacgtctgaacacacaaaggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgtatttttgtgtcgagagagtctattaaagtggctt

SEQ ID NO: 446608 - DNA, 517 bp, Homo sapiens
  misc_feature: HEFZJCU01BJOZA.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttcccctggcaccctcctccaagagcacctctgggggcacagcggccctgggctgcctggtcaaggactacttccagacgtatca

SEQ ID NO: 446609 - DNA, 519 bp, Homo sapiens
  misc_feature: HEFZJCU01EWUIF.12.40.D07.1.454.heavy.3.raw
  modified_base (470)..(470): a, c, t, g, unknown or other
  modified_base (475)..(475): a, c, t, g, unknown or other
atacgacgtacacgaccggtgctcgatttagtgatagagcgtaacaacagagggctcaccatggagtttgggctgagcgtggtttcgtcgtaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcatgttctggggccaggggacccnggtcntcgtctccccagcctccaccaaggcccatcggtctcccctggcg

SEQ ID NO: 446610 - DNA, 391 bp, Homo sapiens
  misc_feature: HEFZJCU01BUNKN.16.24.C02.1.454.heavy.3.raw
tgtactactccacgaccggtgctcgatttagtacagatcgttagggaaggggcgtggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 446611 - DNA, 406 bp, Homo sapiens
  misc_feature: HEFZJCU01C0Y9N.53.77.G11.1.454.heavy.3.raw
cgcgtatacacacgaccggtgctcgatttagctagtcactcaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccattttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 446612 - DNA, 510 bp, Homo sapiens
  misc_feature: HEFZJCU01D4RBP.49.5.A05.1.454.heavy.3.raw
agtcgagagacacgaccggtgctcgatttagatagatagacagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactactggggccagggaa

SEQ ID NO: 446613 - DNA, 524 bp, Homo sapiens; identical to SEQ ID NO: 446401
  misc_feature: HEFZJCU01DAV9C.3.82.H05.1.454.heavy.3.raw

SEQ ID NO: 446614 - DNA, 495 bp, Homo sapiens
  misc_feature: HEFZJCU01BKQED.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttggggt

SEQ ID NO: 446615 - DNA, 527 bp, Homo sapiens
  misc_feature: HEFZJCU01AEO3C.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccacg

SEQ ID NO: 446616 - DNA, 505 bp, Homo sapiens
  misc_feature: HEFZJCU01A9LQP.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtcctggggcccgggaaccgggtc

SEQ ID NO: 446617 - DNA, 445 bp, Homo sapiens
  misc_feature: HEFZJCU01DVL32.49.12.B01.1.454.heavy.3.raw
agtcgagagacacgaccggtgctcgatttagtagtgtagattccgcgggcacgaccggtgctcgatttagctacgctctaagggaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctgggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 446618 - DNA, 379 bp, Homo sapiens; identical to SEQ ID NO: 444450
  misc_feature: HEFZJCU01D1PSB.47.77.G11.1.454.heavy.3.raw

SEQ ID NO: 446619 - DNA, 400 bp, Homo sapiens; identical to SEQ ID NO: 444452
  misc_feature: HEFZJCU01EKQCO.47.24.C02.1.454.heavy.3.raw

SEQ ID NO: 446620 - DNA, 506 bp, Homo sapiens; identical to SEQ ID NO: 446124
  misc_feature: HEFZJCU01DB37X.48.44.D11.1.454.heavy.3.raw

SEQ ID NO: 446621 - DNA, 506 bp, Homo sapiens
  misc_feature: HEFZJCU01DCDY2.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 446622 - DNA, 387 bp, Homo sapiens
  misc_feature: HEFZJCU01DK0AN.18.59.F04.1.454.heavy.3.raw
tacgagtatgcacgaccggtgctcgatttagtacacacacttaggggattggggggctgggagaccggagcccctaggcctttcgggaattcccttaagtgttttcattcagtgagtcaggaactgaacacgagaggacctcaccgatttggggacgtttggggctgtaggctttcggtattttccttggcttgttaacgtattttaaaacggtgttcctagtggtgacggtgctaggcgtggtggaggggtcgtgggggtagggtaacttcggggggtaaacgtccggggggggtcccttaccgtacgttccccctaggtacctacgtccgtcttcggaacttttccaacgttttacgacgttaagggccttgggaattgggaacc

SEQ ID NO: 446623 - DNA, 514 bp, Homo sapiens
  misc_feature: HEFZJCU01DADHY.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtctcccctggcgccctgctccaggagcacctctgggggcacagcggcccg

SEQ ID NO: 446624 - DNA, 514 bp, Homo sapiens
  misc_feature: HEFZJCU01EDSBD.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctcccagcctccaccaagggcccatcggtcttcccctggcgccctcgctccaggagcaccc

SEQ ID NO: 446625 - DNA, 383 bp, Homo sapiens
  misc_feature: HEFZJCU01CQH4L.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctccgaggagcacagccggcccgtgggctgcctggtacaaggactacttcctacgtgagct

SEQ ID NO: 446626 - DNA, 523 bp, Homo sapiens
  misc_feature: HEFZJCU01CKGUI.18.33.C11.1.454.heavy.3.raw
  modified_base (482)..(482): a, c, t, g, unknown or other
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaacctggtcaccgtctcctcacgcctccaccaagggcccatccggtcttcccctggcgccctgctccaggagcacctcgagagcacngcggcctgggctgcctggtcaaggactacttcccatactcg

SEQ ID NO: 446627 - DNA, 519 bp, Homo sapiens; identical to SEQ ID NO: 445330
  misc_feature: HEFZJCU01AHXSF.7.78.H01.1.454.heavy.3.raw

SEQ ID NO: 446628 - DNA, 465 bp, Homo sapiens
  misc_feature: HEFZJCU01ES2EP.48.59.F04.1.454.heavy.3.raw
agtatacatacacgaccggtgctcgatttagtacacacacttagggattggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 446629 - DNA, 517 bp, Homo sapiens
  misc_feature: HEFZJCU01DSC1L.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaggactacttccagacgtatca

SEQ ID NO: 446630 - DNA, 436 bp, Homo sapiens
  misc_feature: HEFZJCU01D2MKA.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggtcctgggctgcctggtcaaggactacttccagtcgctaga

SEQ ID NO: 446631 - DNA, 516 bp, Homo sapiens
  misc_feature: HEFZJCU01EHD4D.4.28.C06.1.454.heavy.3.raw
agcactgtagcacgaccggtgctcgatttagagctcacgtattgggtttgggggccccagccctgggattcccagctgtttctgcttgctgatcaggactgcacacagagaactcaccatggaatttgggctgagctgggttttccttgttgctattttaaaaggtgtccagtgtgaggtgctcctggtggagtccgggggaggcctagttcagcctgggacgtccctaagactctcctgtgcagcctctggattcaccttcagtagttactggctacattgggtccgccaggctccagggaagggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactgggggccccgggacctc

SEQ ID NO: 446632 - DNA, 487 bp, Homo sapiens; identical to SEQ ID NO: 445219
  misc_feature: HEFZJCU01AN209.10.85.H08.1.454.heavy.3.raw

SEQ ID NO: 446633 - DNA, 501 bp, Homo sapiens; identical to SEQ ID NO: 445341
  misc_feature: HEFZJCU01D2J45.48.34.D01.1.454.heavy.3.raw

SEQ ID NO: 446634 - DNA, 395 bp, Homo sapiens
  misc_feature: HEFZJCU01DFEV3.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 446635 - DNA, 399 bp, Homo sapiens
  misc_feature: HEFZJCU01BROFF.16.80.H03.1.454.heavy.3.raw
tgtactactccacgaccggtgctcgatttagctgtgcgtcgaagggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtgaaagatttccgtggctactacgactactactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgagtagtaca

SEQ ID NO: 446636 - DNA, 506 bp, Homo sapiens
  misc_feature: HEFZJCU01C90C8.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggccctc

SEQ ID NO: 446637 - DNA, 507 bp, Homo sapiens
  misc_feature: HEFZJCU01DSMFJ.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctgggctgcctggtcaaggactacttccgagtagtaca

SEQ ID NO: 446638 - DNA, 492 bp, Homo sapiens
  misc_feature: HEFZJCU01EW4ZD.15.67.G01.1.454.heavy.3.raw
tctacgtagccacgaccggtgctcgatttagagtatacatattgggtttgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggtatgatgcttttgatatgtggggccaagggacagtggtcaccgtcacttcagcctccaccaagggcccatcggtcttcccctggcgccctgctccaggagcacctccgagagcacagcggccctgggctgcctggtcaaggactacttccgctacgtaga

SEQ ID NO: 446639 - DNA, 372 bp, Homo sapiens
  misc_feature: HEFZJCU01B7X7H.49.46.E02.1.454.heavy.3.raw
agtcgagagacacgaccggtgctcgatttagactcatctacagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 446640 - DNA, 491 bp, Homo sapiens; identical to SEQ ID NO: 445531
  misc_feature: HEFZJCU01CI2GM.11.38.D05.1.454.heavy.3.raw

SEQ ID NO: 446641 - DNA, 464 bp, Homo sapiens; identical to SEQ ID NO: 445533
  misc_feature: HEFZJCU01D8NM8.19.10.A10.1.454.heavy.3.raw

SEQ ID NO: 446642 - DNA, 495 bp, Homo sapiens
  misc_feature: HEFZJCU01EQGX7.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 446643 - DNA, 509 bp, Homo sapiens
  misc_feature: HEFZJCU01EHHCZ.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgcctgctccaggagcacctccgagagcacagcggccctgggctgcctggtcaaggactactt

SEQ ID NO: 446644 - DNA, 384 bp, Homo sapiens
  misc_feature: HEFZJCU01BF45O.13.42.D09.1.454.heavy.3.raw
tcacgtactacacgaccggtgctcgatttagacacatacgcagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctctggggccaggggacaatggtaaccgtctcttcagcctccaccaagggcccatcggtcttccccctggcgccctgctccaggagcacctccgagagcacagcggccctgggctgcctggtcaaggactacttccgtactagacg

SEQ ID NO: 446645 - DNA, 396 bp, Homo sapiens; identical to SEQ ID NO: 444568
  misc_feature: HEFZJCU01EIMJE.47.46.E02.1.454.heavy.3.raw

SEQ ID NO: 446646 - DNA, 514 bp, Homo sapiens
  misc_feature: HEFZJCU01CHTUG.9.34.D01.1.454.heavy.3.raw
  modified_base (228)..(228): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccncttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcgcctggctgcctggtcaaggactacttccagacgtatca

SEQ ID NO: 446647 - DNA, 517 bp, Homo sapiens
  misc_feature: HEFZJCU01BCIBM.2.11.A11.1.454.heavy.3.raw
acgctcgacacacgaccggtgctcgatttagctacgactgcagggtgtacacctgtggttctcgggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttcccctggcaccctcctccaagagcacctctgggggcacagcggccctgggctgcctggtcaaggactacttcctgtcgagcgt

SEQ ID NO: 446648 - DNA, 497 bp, Homo sapiens; identical to SEQ ID NO: 445179
  misc_feature: HEFZJCU01AFTMA.12.55.E11.1.454.heavy.3.raw

SEQ ID NO: 446649 - DNA, 467 bp, Homo sapiens; identical to SEQ ID NO: 444941
  misc_feature: HEFZJCU01A3DZ0.16.78.H01.1.454.heavy.3.raw

SEQ ID NO: 446650 - DNA, 519 bp, Homo sapiens
  misc_feature: HEFZJCU01BR4RS.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 446651 - DNA, 394 bp, Homo sapiens; identical to SEQ ID NO: 444701
  misc_feature: HEFZJCU01DWQK2.3.12.B01.1.454.heavy.3.raw

SEQ ID NO: 446652 - DNA, 387 bp, Homo sapiens; identical to SEQ ID NO: 445170
  misc_feature: HEFZJCU01CYC9P.27.46.E02.1.454.heavy.3.raw

SEQ ID NO: 446653 - DNA, 508 bp, Homo sapiens
  misc_feature: HEFZJCU01DIC1J.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactactccata

SEQ ID NO: 446654 - DNA, 324 bp, Homo sapiens; identical to SEQ ID NO: 444475
  misc_feature: HEFZJCU01E1ZSN.18.17.B06.1.454.heavy.3.raw

SEQ ID NO: 446655 - DNA, 515 bp, Homo sapiens
  misc_feature: HEFZJCU01CAGJN.51.30.C08.1.454.heavy.3.raw
cgatcgtatacacgaccggtgctcgatttagtctgacgtcaaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaacgggcccatcggtccttcccctggccgccctcgcctccaggagccacctccgacgagcacacggccggcccc

SEQ ID NO: 446656 - DNA, 384 bp, Homo sapiens; identical to SEQ ID NO: 444454
  misc_feature: HEFZJCU01DV3GV.11.61.F06.1.454.heavy.3.raw

SEQ ID NO: 446657 - DNA, 464 bp, Homo sapiens
  misc_feature: HEFZJCU01DG10U.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagagcacagccggccctgggctgcctggtcaaggactacttcccacgagagta

SEQ ID NO: 446658 - DNA, 491 bp, Homo sapiens; identical to SEQ ID NO: 444749
  misc_feature: HEFZJCU01AW092.11.13.B02.1.454.heavy.3.raw

SEQ ID NO: 446659 - DNA, 503 bp, Homo sapiens
  misc_feature: HEFZJCU01EXVY3.49.37.D04.1.454.heavy.3.raw
agtcgagagacacgaccggtgctcgatttagtagcatactgttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaaggcccatcggtcttcccctggccgcctgctcc

SEQ ID NO: 446660 - DNA, 385 bp, Homo sapiens; identical to SEQ ID NO: 444438
  misc_feature: HEFZJCU01DCEQV.18.60.F05.1.454.heavy.3.raw

SEQ ID NO: 446661 - DNA, 505 bp, Homo sapiens
  misc_feature: HEFZJCU01DY2FU.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctgcgcctgctccaggagcacctccgagagcacagcggccc

SEQ ID NO: 446662 - DNA, 481 bp, Homo sapiens; identical to SEQ ID NO: 445006
  misc_feature: HEFZJCU01AKG0U.7.10.A10.1.454.heavy.3.raw

SEQ ID NO: 446663 - DNA, 518 bp, Homo sapiens; identical to SEQ ID NO: 446027
  misc_feature: HEFZJCU01EZYP4.9.34.D01.1.454.heavy.3.raw

SEQ ID NO: 446664 - DNA, 375 bp, Homo sapiens
  misc_feature: HEFZJCU01E0638.49.33.C11.1.454.heavy.3.raw
agtcgagagacacgaccggtgctcgatttagagtgagctcgttgggtttgggggggagaggagcccagcactgggattccgaggtgtttccattcagtgatctgcactgaacacagaggactcgccatggagtttgggctgagctgggttttccttgttgctattttaaaaggtgtccagtgtgatgtgcaggtggtggagcccgggtatagcagtgtctggtacatattactggggccagggaaccctggtcaccgtctcctcagcctccaccaagggcccatcggtcttccccctggcgccctgctccaggagcacctccgagagcacagcggccctgggctgcctggtcaaggactacttcctctctcgact

SEQ ID NO: 446665 - DNA, 532 bp, Homo sapiens
  misc_feature: HEFZJCU01BTIFG.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaagagcacctctgggggcacagcggccctgggctgcctc

SEQ ID NO: 446666 - DNA, 520 bp, Homo sapiens
  misc_feature: HEFZJCU01AWF7V.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccaagagcacctctgggggcacagcggccctgggctgcctggtcaaggactacttcctagagacacg

SEQ ID NO: 446667 - DNA, 519 bp, Homo sapiens; identical to SEQ ID NO: 444867
  misc_feature: HEFZJCU01EFJPP.9.34.D01.1.454.heavy.3.raw

SEQ ID NO: 446668 - DNA, 516 bp, Homo sapiens
  misc_feature: HEFZJCU01DVYEA.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtctcccctggcaccctcctccaagagcacctctgggggcacagcggccctggctgcctggtcaaggactacttcctagagacacg

SEQ ID NO: 446669 - DNA, 483 bp, Homo sapiens; identical to SEQ ID NO: 444924
  misc_feature: HEFZJCU01CVPZW.10.35.D02.1.454.heavy.3.raw

SEQ ID NO: 446670 - DNA, 392 bp, Homo sapiens
  misc_feature: HEFZJCU01E1RAY.53.60.F05.1.454.heavy.3.raw
cgcgtatacacacgaccggtgctcgatttagtacgtcatcagggaaagggcctggagtgggtctcacatattagttgggggagtcgcagcctaggatatgcggagtctgtgaggggccggttcaccatctccagagacgacgccaggagttccttgtatctgcaaatgaacagtctgagaactgaagacacggccctctactattgtgtaaaaggggcactcggatacagcagcagttggtatgaccactggggccagggaatcctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 446671 - DNA, 391 bp, Homo sapiens; identical to SEQ ID NO: 444514
  misc_feature: HEFZJCU01DGEFO.12.24.C02.1.454.heavy.3.raw

SEQ ID NO: 446672 - DNA, 504 bp, Homo sapiens
  misc_feature: HEFZJCU01DH7RO.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttccactacta

SEQ ID NO: 446673 - DNA, 508 bp, Homo sapiens
  misc_feature: HEFZJCU01BOPPA.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaacctattattgtgcgcgacatgactacgctcaattctggggccaggggacg

SEQ ID NO: 446674 - DNA, 524 bp, Homo sapiens
  misc_feature: HEFZJCU01EM0OE.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccagagcacctccgagagcacagcggccctgggc

SEQ ID NO: 446675 - DNA, 511 bp, Homo sapiens
  misc_feature: HEFZJCU01DBS8G.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactactggggccagggaaccctggtcaccgt

SEQ ID NO: 446676 - DNA, 506 bp, Homo sapiens; identical to SEQ ID NO: 444696
  misc_feature: HEFZJCU01CWXPS.16.34.D01.1.454.heavy.3.raw

SEQ ID NO: 446677 - DNA, 505 bp, Homo sapiens; identical to SEQ ID NO: 445664
  misc_feature: HEFZJCU01D40E4.12.33.C11.1.454.heavy.3.raw

SEQ ID NO: 446678 - DNA, 427 bp, Homo sapiens; identical to SEQ ID NO: 444708
  misc_feature: HEFZJCU01D9HI9.9.34.D01.1.454.heavy.3.raw

SEQ ID NO: 446679 - DNA, 385 bp, Homo sapiens; identical to SEQ ID NO: 444438
  misc_feature: HEFZJCU01EO6VB.18.60.F05.1.454.heavy.3.raw

SEQ ID NO: 446680 - DNA, 396 bp, Homo sapiens; identical to SEQ ID NO: 444469
  misc_feature: HEFZJCU01COVN5.47.46.E02.1.454.heavy.3.raw

SEQ ID NO: 446681 - DNA, 400 bp, Homo sapiens; identical to SEQ ID NO: 444452
  misc_feature: HEFZJCU01DDHN1.47.24.C02.1.454.heavy.3.raw

SEQ ID NO: 446682 - DNA, 315 bp, Homo sapiens
  misc_feature: HEFZJCU01CGNS7.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttccctagagacacg

SEQ ID NO: 446683 - DNA, 403 bp, Homo sapiens; identical to SEQ ID NO: 444540
  misc_feature: HEFZJCU01ER7UA.16.72.G06.1.454.heavy.3.raw

SEQ ID NO: 446684 - DNA, 411 bp, Homo sapiens
  misc_feature: HEFZJCU01CKJ9E.51.60.F05.1.454.heavy.3.raw
cgatcgtatacacgaccggtgctcgatttagtacgtcatcagggaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctggggcacagcggccctgggctgcctggtcaaggactacttcctcgtagcact

SEQ ID NO: 446685 - DNA, 483 bp, Homo sapiens; identical to SEQ ID NO: 444639
  misc_feature: HEFZJCU01B8ZJ0.11.23.C01.1.454.heavy.3.raw

SEQ ID NO: 446686 - DNA, 387 bp, Homo sapiens
  misc_feature: HEFZJCU01BD3AQ.49.34.D01.1.454.heavy.3.raw
agtcgagagacacgaccggtgctcgatttagatcgtctgtgttgggtttgggatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446687 - DNA, 517 bp, Homo sapiens; identical to SEQ ID NO: 446039
  misc_feature: HEFZJCU01CNMUU.9.70.G04.1.454.heavy.3.raw

SEQ ID NO: 446688 - DNA, 509 bp, Homo sapiens
  misc_feature: HEFZJCU01BIZRS.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccct

SEQ ID NO: 446689 - DNA, 502 bp, Homo sapiens
  misc_feature: HEFZJCU01ANJSW.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggccgccctgctccaggagcacctccgagagcacagcggccctgggctgcctggtcaaggactacttccagacgtatca

SEQ ID NO: 446690 - DNA, 517 bp, Homo sapiens
  misc_feature: HEFZJCU01D6346.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctgggctgcctggtcaaggactactcctagagacacg

SEQ ID NO: 446691 - DNA, 396 bp, Homo sapiens; identical to SEQ ID NO: 444469
  misc_feature: HEFZJCU01BWMKI.47.46.E02.1.454.heavy.3.raw

SEQ ID NO: 446692 - DNA, 499 bp, Homo sapiens
  misc_feature: HEFZJCU01CO1U1.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggccaccctcctccaagagcacctctgggggcacagcggccctgggctgccctggtcaaggactacttccgagtagtaca

SEQ ID NO: 446693 - DNA, 500 bp, Homo sapiens
  misc_feature: HEFZJCU01DJBRO.22.86.H09.1.454.heavy.3.raw
acatacgcgtcacgaccggtgctcgatttagtgctatagacttgggtttgggctgagcgtggtttcgtcgtaggctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtaattactgtgcgagagatcgacatgactacgggaaagcttttgatctctggggccaagggacactggtcaccgtctcttcagcctccaccaagggcccatcggtcttcccctggcgcctgctcc

SEQ ID NO: 446694 - DNA, 402 bp, Homo sapiens; identical to SEQ ID NO: 444815
  misc_feature: HEFZJCU01C58XL.11.70.G04.1.454.heavy.3.raw

SEQ ID NO: 446695 - DNA, 383 bp, Homo sapiens
  misc_feature: HEFZJCU01B8OCV.22.85.H08.1.454.heavy.3.raw
acatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttccacgcgtatgt

SEQ ID NO: 446696 - DNA, 399 bp, Homo sapiens; identical to SEQ ID NO: 444537
  misc_feature: HEFZJCU01CQHQ9.16.29.C07.1.454.heavy.3.raw

SEQ ID NO: 446697 - DNA, 486 bp, Homo sapiens
  misc_feature: HEFZJCU01C7HAB.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggggtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttccactactatg

SEQ ID NO: 446698 - DNA, 513 bp, Homo sapiens
  misc_feature: HEFZJCU01BD8Q2.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctggggcacagcggcccg

SEQ ID NO: 446699 - DNA, 513 bp, Homo sapiens
  misc_feature: HEFZJCU01BBSI2.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtct

SEQ ID NO: 446700 - DNA, 533 bp, Homo sapiens
  misc_feature: HEFZJCU01D5ZTQ.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttccccctggcaccctcctccaagagcacctctgggggcacagcggccctggctgcctggtcaaggactacttccgtatctctcg

SEQ ID NO: 446701 - DNA, 510 bp, Homo sapiens
  misc_feature: HEFZJCU01BNGN7.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacgggaaagctttgatctctggggccaagggacactggtcaccgtctcttcagcctccaccaagggcccagtcggtcttccccctggccgccctgctccaggacg

SEQ ID NO: 446702 - DNA, 512 bp, Homo sapiens
  misc_feature: HEFZJCU01CJY4D.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaaggactacttccgtactacg

SEQ ID NO: 446703 - DNA, 519 bp, Homo sapiens; identical to SEQ ID NO: 445617
  misc_feature: HEFZJCU01DOPDM.9.34.D01.1.454.heavy.3.raw

SEQ ID NO: 446704 - DNA, 416 bp, Homo sapiens
  misc_feature: HEFZJCU01B1OA8.51.85.H08.1.454.heavy.3.raw
cgatcgtatacacgaccggtgctcgatttagtatcactcagtcgcgggggctctgggagaggagaccagcactagaagtcggcggtgtttccattcggtgatcagcactgaacacagaggtctcaccatggagtttgggctgcgctggattttcctcgttgctctttttagaggtgcccagtgtcagatacaactggtggagtcggggggaggcgtggtccagcctgggggtccctgagagtctcgtgtgcagcctctggattcaccttcaggcgttacggcatgaactgggtccgccaggctccagcctccaccaagggcccatcggtcttccccctggcaccctcctccaagagcacctctgggggcacagcggccctgggctgcctggtcaaggactacttcctcgtagcact

SEQ ID NO: 446705 - DNA, 517 bp, Homo sapiens
  misc_feature: HEFZJCU01C2DSE.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcacgtctcctcagcctccaccaagggcccatcggtcttcccctggccaccctcctccaagagcacctctgggggcacagcggcctgggctgcctggtcaaggactacttcctagagacacg

SEQ ID NO: 446706 - DNA, 492 bp, Homo sapiens
  misc_feature: HEFZJCU01C4H7F.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctat

SEQ ID NO: 446707 - DNA, 489 bp, Homo sapiens; identical to SEQ ID NO: 444591
  misc_feature: HEFZJCU01B6GCY.18.70.G04.1.454.heavy.3.raw

SEQ ID NO: 446708 - DNA, 546 bp, Homo sapiens
  misc_feature: HEFZJCU01DNXAW.48.3.A03.1.454.heavy.3.raw
agtatacatacacgaccggtgctcgatttagagagcgtcacagggggctctgagagaggagcccagccctgggattttcaggtgttttcacttggtgatcaggactgaacagagagaactcaccatggagtttgggctgagcgtggtcgttttcttacgtcggccattttaaaaggtgtccagtgtgaggagcagttgtcggaatctgggggagacctggtacagccggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtactttgaactctggggtcagggaaccctggtcaccgtctcctcag

SEQ ID NO: 446709 - DNA, 490 bp, Homo sapiens; identical to SEQ ID NO: 446389
  misc_feature: HEFZJCU01DLRTA.3.34.D01.1.454.heavy.3.raw

SEQ ID NO: 446710 - DNA, 406 bp, Homo sapiens
  misc_feature: HEFZJCU01DAPOI.13.30.C08.1.454.heavy.3.raw
tcacgtactacacgaccggtgctcgatttagtctgacgtcaaagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 446711 - DNA, 477 bp, Homo sapiens; identical to SEQ ID NO: 444659
  misc_feature: HEFZJCU01CTVJD.16.10.A10.1.454.heavy.3.raw

SEQ ID NO: 446712 - DNA, 477 bp, Homo sapiens; identical to SEQ ID NO: 444659
  misc_feature: HEFZJCU01AECFF.16.10.A10.1.454.heavy.3.raw

SEQ ID NO: 446713 - DNA, 520 bp, Homo sapiens
  misc_feature: HEFZJCU01EXMR3.12.40.D07.1.454.heavy.3.raw
atacgacgtacacgaccggtgctcgatttagtgatagagcgtaacaacagagggctcaccatggagtttgggctgagcgtggtttcgtcgttaggctctttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaagggcccatcggtcttcccctggcg

SEQ ID NO: 446714 - DNA, 379 bp, Homo sapiens; identical to SEQ ID NO: 444450
  misc_feature: HEFZJCU01DW301.47.77.G11.1.454.heavy.3.raw

SEQ ID NO: 446715 - DNA, 491 bp, Homo sapiens; identical to SEQ ID NO: 445531
  misc_feature: HEFZJCU01C9GMO.11.38.D05.1.454.heavy.3.raw

SEQ ID NO: 446716 - DNA, 384 bp, Homo sapiens; identical to SEQ ID NO: 444454
  misc_feature: HEFZJCU01A2VQG.11.61.F06.1.454.heavy.3.raw

SEQ ID NO: 446717 - DNA, 391 bp, Homo sapiens
  misc_feature: HEFZJCU01CBJZG.13.86.H09.1.454.heavy.3.raw
tcacgtactacacgaccggtgctcgatttagtgctatagacttgggtttgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtcttccccctggcaccctcctccaagagcacctctgggggcacagcggccctgggctgcctggtcaaggactacttcctagtacgtga

SEQ ID NO: 446718 - DNA, 383 bp, Homo sapiens
  misc_feature: HEFZJCU01BV9TC.11.61.F06.1.454.heavy.3.raw
cgagagataccacgaccggtgctcgatttagctacgctctaagggaaggggctggtgtgggtctcacgtattgacaatgatgggagtgacataatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 446719 - DNA, 507 bp, Homo sapiens
  misc_feature: HEFZJCU01DD55A.48.44.D11.1.454.heavy.3.raw
agtatacatacacgaccggtgctcgatttagcgcagtacgaagggaggcttggtccagcctgggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 446720 - DNA, 400 bp, Homo sapiens; identical to SEQ ID NO: 444452
  misc_feature: HEFZJCU01DZ0MH.47.24.C02.1.454.heavy.3.raw

SEQ ID NO: 446721 - DNA, 379 bp, Homo sapiens; identical to SEQ ID NO: 444450
  misc_feature: HEFZJCU01BS7O5.47.77.G11.1.454.heavy.3.raw

SEQ ID NO: 446722 - DNA, 505 bp, Homo sapiens; identical to SEQ ID NO: 444759
  misc_feature: HEFZJCU01DE4AJ.10.38.D05.1.454.heavy.3.raw

SEQ ID NO: 446723 - DNA, 488 bp, Homo sapiens
  misc_feature: HEFZJCU01DJZAV.4.53.E09.1.454.heavy.3.raw
agcactgtagcacgaccggtgctcgatttagagagagtgtgttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggacccggctgtctattactgtgcgaggaagaagtattactatgatacaagtgacatgggctggttcgacccctggggccagggaaccctggtcaccgtctcctcagcctccaccaagggcccatcggtcttcccctggcgccctgctccaggagcacctccgagagcacagcggccctgggctgcctggtcaaggactacttccctacagtgct

SEQ ID NO: 446724 - DNA, 494 bp, Homo sapiens
  misc_feature: HEFZJCU01CAUFH.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaagggctggtctgggtcgtctcgtattgatagtgatggcagtaccagaggatatgcggacgccgtgaggggccggattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttccccctggcgccctgctccaggagcacctccgagagcacagcggccctgggctgcctggtcaaggactacttccctacagtgct

SEQ ID NO: 446725 - DNA, 520 bp, Homo sapiens
  misc_feature: HEFZJCU01AYNGU.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccc

SEQ ID NO: 446726 - DNA, 390 bp, Homo sapiens; identical to SEQ ID NO: 444541
  misc_feature: HEFZJCU01EJ2TE.16.24.C02.1.454.heavy.3.raw

SEQ ID NO: 446727 - DNA, 515 bp, Homo sapiens
  misc_feature: HEFZJCU01BXUYU.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctgcgccctcgctccaggagcacctctgggggcacagcggcccg

SEQ ID NO: 446728 - DNA, 518 bp, Homo sapiens
  misc_feature: HEFZJCU01B1B0W.21.86.H09.1.454.heavy.3.raw
tcgtcgctcgcacgaccggtgctcgatttagtgctatagacttgggtttggggggaagaggaagactgacggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggccagggaaccctagtcaccgtctcctcagcctccaccaagggcccatcggtcttcccctggcgccctgctccaggagcacctccgagagcacagcggccctgggctgcctggtcaaggactactccgtacg

SEQ ID NO: 446729 - DNA, 395 bp, Homo sapiens
  misc_feature: HEFZJCU01BMCL3.47.46.E02.1.454.heavy.3.raw
agctcacgtacacgaccggtgctcgatttagactcatctacaggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctgggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 446730 - DNA, 324 bp, Homo sapiens
  misc_feature: HEFZJCU01AZY34.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacgactgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 446731 - DNA, 544 bp, Homo sapiens
  misc_feature: HEFZJCU01EUNCD.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaagggctggagtgggttggccgtattaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctagaaagcgtacaactactactactacggtatggacctcgtcggggccaagggacccg

SEQ ID NO: 446732 - DNA, 534 bp, Homo sapiens
  misc_feature: HEFZJCU01A2ATA.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgtttcgagacatgccgaccgagagcattatcggcagtacggttttgattattttgggggccaaggggaactaccggtggtcctaccgtcctccacacgccctacccg

SEQ ID NO: 446733 - DNA, 505 bp, Homo sapiens; identical to SEQ ID NO: 445122
  misc_feature: HEFZJCU01EO3SJ.49.31.C09.1.454.heavy.3.raw

SEQ ID NO: 446734 - DNA, 520 bp, Homo sapiens
  misc_feature: HEFZJCU01EGO0Y.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaaggcccatcggtcttccccctggcaccctcctccaagagcacctctgggggcacacg

SEQ ID NO: 446735 - DNA, 484 bp, Homo sapiens; identical to SEQ ID NO: 445876
  misc_feature: HEFZJCU01A3SPE.8.39.D06.1.454.heavy.3.raw

SEQ ID NO: 446736 - DNA, 523 bp, Homo sapiens
  misc_feature: HEFZJCU01CY8UB.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 446737 - DNA, 400 bp, Homo sapiens; identical to SEQ ID NO: 444452
  misc_feature: HEFZJCU01DSI7J.47.24.C02.1.454.heavy.3.raw

SEQ ID NO: 446738 - DNA, 501 bp, Homo sapiens
  misc_feature: HEFZJCU01BFQCC.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgcctgctccaggagcacctccgagagcacagcggcctgggctgcctggtcaaggactacttccagacgtatca

SEQ ID NO: 446739 - DNA, 496 bp, Homo sapiens
  misc_feature: HEFZJCU01CGZE5.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggccaccctcctccaagagcacctctgggggcacagcggccctgggctgcctggtcaaggactacttcctcgtagcact

SEQ ID NO: 446740 - DNA, 396 bp, Homo sapiens; identical to SEQ ID NO: 444469
  misc_feature: HEFZJCU01BJPQ5.47.46.E02.1.454.heavy.3.raw

SEQ ID NO: 446741 - DNA, 506 bp, Homo sapiens
  misc_feature: HEFZJCU01AP60R.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggcctcgggtttctcagtgcctggtttgtagaactggggccgagggactactggtcaccgtctcctccagcctcctaccg

SEQ ID NO: 446742 - DNA, 554 bp, Homo sapiens
  misc_feature: HEFZJCU01B5JDX.48.40.D07.1.454.heavy.3.raw
agtatacatacacgaccggtgctcgatttagtgatagagcgtaacaacagagggctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactattggggtcgggggaacccgtggtcaccgtctcctcagcctccaccaagggcccatcggtcttccccctggcaccctcctccaagagcacctctgggggc

SEQ ID NO: 446743 - DNA, 496 bp, Homo sapiens; identical to SEQ ID NO: 446592
  misc_feature: HEFZJCU01BPT7F.4.75.G09.1.454.heavy.3.raw

SEQ ID NO: 446744 - DNA, 515 bp, Homo sapiens
  misc_feature: HEFZJCU01BHIVV.52.78.H01.1.454.heavy.3.raw
cgcagtacgacacgaccggtgctcgatttagtgtgagtagtttgggtttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacgggccgtgtattactgtgcgagagttctttgggatgttgtcgttgcaccagctgccctacccggctgctacttcgatctctggggccgtggcaccctggtcactgtcttctcagcctccaccaagggccatcggtcttcccctgg

SEQ ID NO: 446745 - DNA, 525 bp, Homo sapiens
  misc_feature: HEFZJCU01C1K27.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggccagggaaccctggtcaccgtctcctcagcctcaccg

SEQ ID NO: 446746 - DNA, 483 bp, Homo sapiens; identical to SEQ ID NO: 444924
  misc_feature: HEFZJCU01DMKAB.10.35.D02.1.454.heavy.3.raw

SEQ ID NO: 446747 - DNA, 524 bp, Homo sapiens
  misc_feature: HEFZJCU01C0MWQ.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcc

SEQ ID NO: 446748 - DNA, 505 bp, Homo sapiens; identical to SEQ ID NO: 445664
  misc_feature: HEFZJCU01B7HSB.12.33.C11.1.454.heavy.3.raw

SEQ ID NO: 446749 - DNA, 521 bp, Homo sapiens
  misc_feature: HEFZJCU01C355M.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacacg

SEQ ID NO: 446750 - DNA, 413 bp, Homo sapiens
  misc_feature: HEFZJCU01BMK1C.13.86.H09.1.454.heavy.3.raw
tcacgtactacacgaccggtgctcgatttagtgctatagacttgggtttgggtccgcctgtccccagggaaggggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttccgtactagacg

SEQ ID NO: 446751 - DNA, 462 bp, Homo sapiens
  misc_feature: HEFZJCU01AFQSE.4.6.A06.1.454.heavy.3.raw
agcactgtagcacgaccggtgctcgatttagatctactgacagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgcttttgatatctggggccaagggacaatggtcaccgtctcttcagcctccaccaagggcccatcggtcttcccctcggcaccctcctccaagagcacctctgggggcacagcggccctgggctgcctggtcaaggactacttccctacagtgct

SEQ ID NO: 446752 - DNA, 338 bp, Homo sapiens
  misc_feature: HEFZJCU01BOBWO.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggt

SEQ ID NO: 446753 - DNA, 383 bp, Homo sapiens
  misc_feature: HEFZJCU01EEBS3.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 446754 - DNA, 503 bp, Homo sapiens
  misc_feature: HEFZJCU01DT15Y.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgattgccttcggtccgcggggacttctggggg

SEQ ID NO: 446755 - DNA, 508 bp, Homo sapiens; identical to SEQ ID NO: 445594
  misc_feature: HEFZJCU01DXPYD.17.25.C03.1.454.heavy.3.raw

SEQ ID NO: 446756 - DNA, 499 bp, Homo sapiens
  misc_feature: HEFZJCU01EPPYL.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggccgccctgctccaggagcacctccgagagcacagccggccctgggctgcctggtcaaggactaccg

SEQ ID NO: 446757 - DNA, 491 bp, Homo sapiens; identical to SEQ ID NO: 445333
  misc_feature: HEFZJCU01EIATA.19.53.E09.1.454.heavy.3.raw

SEQ ID NO: 446758 - DNA, 400 bp, Homo sapiens; identical to SEQ ID NO: 444452
  misc_feature: HEFZJCU01CUX0C.47.24.C02.1.454.heavy.3.raw

SEQ ID NO: 446759 - DNA, 323 bp, Homo sapiens
  misc_feature: HEFZJCU01DC2E7.9.29.C07.1.454.heavy.3.raw
tgatacgtctcacgaccggtgctcgatttagagtgctacgaagggaaagggccggttcaccatctccagagacaattccaagaacacgctgtatttgcaaatgaacagcctgagagccgaagacacggccgtctattactgtgcgagattaccgcatacggtgactacctactttctcgactggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 446760 - DNA, 371 bp, Homo sapiens; identical to SEQ ID NO: 444919
  misc_feature: HEFZJCU01B17L8.3.1.A01.1.454.heavy.3.raw

SEQ ID NO: 446761 - DNA, 432 bp, Homo sapiens; identical to SEQ ID NO: 444920
  misc_feature: HEFZJCU01DRHRZ.11.39.D06.1.454.heavy.3.raw

SEQ ID NO: 446762 - DNA, 513 bp, Homo sapiens
  misc_feature: HEFZJCU01AQW3Q.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagagcacctctgggggcacagcggccctgggctgcctggtcaaggactacttccgtactacg

SEQ ID NO: 446763 - DNA, 478 bp, Homo sapiens
  misc_feature: HEFZJCU01CG1RB.49.8.A08.1.454.heavy.3.raw
agtcgagagacacgaccggtgctcgatttagcatactctacaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaactt

SEQ ID NO: 446764 - DNA, 393 bp, Homo sapiens
  misc_feature: HEFZJCU01BFZNY.49.42.D09.1.454.heavy.3.raw
agtcgagagacacgaccggtgctcgatttagacacatacgcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446765 - DNA, 379 bp, Homo sapiens
  misc_feature: HEFZJCU01A9L1T.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgtcctgctccaggagcacctctgggggcacagcggccctgggctgcctggtcaaggactacttcctacgtgagct

SEQ ID NO: 446766 - DNA, 500 bp, Homo sapiens
  misc_feature: HEFZJCU01DAWQS.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtggaagagacgttggtggctaccgcggggctgaccactggggccg

SEQ ID NO: 446767 - DNA, 400 bp, Homo sapiens; identical to SEQ ID NO: 444452
  misc_feature: HEFZJCU01BBPM2.47.24.C02.1.454.heavy.3.raw

SEQ ID NO: 446768 - DNA, 396 bp, Homo sapiens; identical to SEQ ID NO: 444469
  misc_feature: HEFZJCU01ASY0E.47.46.E02.1.454.heavy.3.raw

SEQ ID NO: 446769 - DNA, 487 bp, Homo sapiens
  misc_feature: HEFZJCU01CAGLF.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgacg

SEQ ID NO: 446770 - DNA, 339 bp, Homo sapiens; identical to SEQ ID NO: 444436
  misc_feature: HEFZJCU01A2RTH.47.38.D05.1.454.heavy.3.raw

SEQ ID NO: 446771 - DNA, 382 bp, Homo sapiens
  misc_feature: HEFZJCU01EH0B0.22.85.H08.1.454.heavy.3.raw
acatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccacctccaccaagggcccatcggtcttccccctggcaccctcctccaagagcacctctgggggcacagcggccctgggctgcctggtcaaggactacttccagacgtatca

SEQ ID NO: 446772 - DNA, 518 bp, Homo sapiens
  misc_feature: HEFZJCU01CDVMW.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggcggggaaccctggtcaccgtctcttcagcctccaccaagggcccatcggtcttcccctggcaccctcctccaagagcacctctgggggcacagcc

SEQ ID NO: 446773 - DNA, 395 bp, Homo sapiens; identical to SEQ ID NO: 444517
  misc_feature: HEFZJCU01CCBHE.16.68.G02.1.454.heavy.3.raw

SEQ ID NO: 446774 - DNA, 480 bp, Homo sapiens
  misc_feature: HEFZJCU01CIWKV.49.8.A08.1.454.heavy.3.raw
agtcgagagacacgaccggtgctcgatttagcatactctacagggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttaatcacgg

SEQ ID NO: 446775 - DNA, 527 bp, Homo sapiens
  misc_feature: HEFZJCU01EIGZV.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 446776 - DNA, 533 bp, Homo sapiens
  misc_feature: HEFZJCU01DJ1T4.48.29.C07.1.454.heavy.3.raw
  modified_base (460)..(460): a, c, t, g, unknown or other
agtatacatacacgaccggtgctcgatttagagtgctacgaagggaaaggggggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctcagcctccaccaagggcccatcggtcttccccctggcaccctcctccaagagcacctccgagggcncacaggccgccggtcggcgtcgtccgtcggtacgaacggtaccttaccttcctagttagtactactcgtagac

SEQ ID NO: 446777 - DNA, 521 bp, Homo sapiens
  misc_feature: HEFZJCU01D9BIP.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcaccctcctccaagagcacctctgggggcacagcggccctgggctgcctggtcaa

SEQ ID NO: 446778 - DNA, 514 bp, Homo sapiens
  misc_feature: HEFZJCU01D6KW9.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctggggaactctggtcaccgtct

SEQ ID NO: 446779 - DNA, 383 bp, Homo sapiens
  misc_feature: HEFZJCU01D03JH.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcgccctgctccaggagcacctccgagagcacagcggccctgggctgcctggtcaaggactacttcctacgtgagct

SEQ ID NO: 446780 - DNA, 511 bp, Homo sapiens
  misc_feature: HEFZJCU01DTVQ4.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcggtgcgtttctaggtggctaattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggcc

SEQ ID NO: 446781 - DNA, 524 bp, Homo sapiens
  misc_feature: HEFZJCU01D0GOF.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgcctccaggggggacctttggggtttcgacccctggggccagggaaccctggtcaccgtctcctcagcctccaccaagggcccatcggtcttcccctggcaccctcctccaagagcacctctgggggcacagcc

SEQ ID NO: 446782 - DNA, 506 bp, Homo sapiens; identical to SEQ ID NO: 446520
  misc_feature: HEFZJCU01BCG61.10.38.D05.1.454.heavy.3.raw

SEQ ID NO: 446783 - DNA, 493 bp, Homo sapiens
  misc_feature: HEFZJCU01ATCGF.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggcctggctgcctggtcaaggactac

SEQ ID NO: 446784 - DNA, 500 bp, Homo sapiens; identical to SEQ ID NO: 444529
  misc_feature: HEFZJCU01AXXB1.12.38.D05.1.454.heavy.3.raw

SEQ ID NO: 446785 - DNA, 391 bp, Homo sapiens; identical to SEQ ID NO: 444514
  misc_feature: HEFZJCU01BH4WT.12.24.C02.1.454.heavy.3.raw

SEQ ID NO: 446786 - DNA, 403 bp, Homo sapiens; identical to SEQ ID NO: 444540
  misc_feature: HEFZJCU01AX213.16.72.G06.1.454.heavy.3.raw

SEQ ID NO: 446787 - DNA, 492 bp, Homo sapiens
  misc_feature: HEFZJCU01EX3D4.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 446788 - DNA, 522 bp, Homo sapiens
  misc_feature: HEFZJCU01CFHJT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 446789 - DNA, 384 bp, Homo sapiens; identical to SEQ ID NO: 444454
  misc_feature: HEFZJCU01CJIYD.11.61.F06.1.454.heavy.3.raw

SEQ ID NO: 446790 - DNA, 396 bp, Homo sapiens; identical to SEQ ID NO: 444469
  misc_feature: HEFZJCU01A35DM.47.46.E02.1.454.heavy.3.raw

SEQ ID NO: 446791 - DNA, 315 bp, Homo sapiens; identical to SEQ ID NO: 444763
  misc_feature: HEFZJCU01BZMQ7.47.56.F01.1.454.heavy.3.raw

SEQ ID NO: 446792 - DNA, 509 bp, Homo sapiens
  misc_feature: HEFZJCU01B0GTC.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggagcacctctgggggcacagcggccctgggctgcctggtcaaggactactcccata

SEQ ID NO: 446793 - DNA, 414 bp, Homo sapiens
  misc_feature: HEFZJCU01BPL55.51.42.D09.1.454.heavy.3.raw
cgatcgtatacacgaccggtgctcgatttagacacatacgcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 446794 - DNA, 371 bp, Homo sapiens; identical to SEQ ID NO: 444919
  misc_feature: HEFZJCU01BG6GP.3.1.A01.1.454.heavy.3.raw

SEQ ID NO: 446795 - DNA, 395 bp, Homo sapiens; identical to SEQ ID NO: 444517
  misc_feature: HEFZJCU01E0DVN.16.68.G02.1.454.heavy.3.raw

SEQ ID NO: 446796 - DNA, 513 bp, Homo sapiens
  misc_feature: HEFZJCU01EB5RO.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaatgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggcg

SEQ ID NO: 446797 - DNA, 324 bp, Homo sapiens; identical to SEQ ID NO: 444475
  misc_feature: HEFZJCU01B2XD9.18.17.B06.1.454.heavy.3.raw

SEQ ID NO: 446798 - DNA, 492 bp, Homo sapiens
  misc_feature: HEFZJCU01D49FO.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgacgagta

SEQ ID NO: 446799 - DNA, 511 bp, Homo sapiens
  misc_feature: HEFZJCU01DMQ53.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactacttcccata

SEQ ID NO: 446800 - DNA, 379 bp, Homo sapiens; identical to SEQ ID NO: 444773
  misc_feature: HEFZJCU01D5T1X.3.59.F04.1.454.heavy.3.raw

SEQ ID NO: 446801 - DNA, 482 bp, Homo sapiens; identical to SEQ ID NO: 444503
  misc_feature: HEFZJCU01CU3XI.7.10.A10.1.454.heavy.3.raw

SEQ ID NO: 446802 - DNA, 516 bp, Homo sapiens
  misc_feature: HEFZJCU01AZHWJ.52.37.D04.1.454.heavy.3.raw
cgcagtacgacacgaccggtgctcgatttagtagcatactgttgggtttggggtgctcgatttagtgtgagtagtttgggtttgggctcaactctcttgtccaccttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctc

SEQ ID NO: 446803 - DNA, 505 bp, Homo sapiens; identical to SEQ ID NO: 445664
  misc_feature: HEFZJCU01CPNTD.12.33.C11.1.454.heavy.3.raw

SEQ ID NO: 446804 - DNA, 491 bp, Homo sapiens
  misc_feature: HEFZJCU01D4X28.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgcgacagaaagagattccatactcaggcggggcactatggcagcagctg

SEQ ID NO: 446805 - DNA, 499 bp, Homo sapiens
  misc_feature: HEFZJCU01CA52O.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggac

SEQ ID NO: 446806 - DNA, 482 bp, Homo sapiens; identical to SEQ ID NO: 444503
  misc_feature: HEFZJCU01ECZ5B.7.10.A10.1.454.heavy.3.raw

SEQ ID NO: 446807 - DNA, 504 bp, Homo sapiens
  misc_feature: HEFZJCU01EAI4A.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggccaccctcctccaagagcacctctgggggcacagcgcctgggctgcctggtcaaggactacttcctacgtcgtat

SEQ ID NO: 446808 - DNA, 511 bp, Homo sapiens
  misc_feature: HEFZJCU01APK4H.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaagggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 446809 - DNA, 510 bp, Homo sapiens
  misc_feature: HEFZJCU01BTW3F.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagaggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactt

SEQ ID NO: 446810 - DNA, 520 bp, Homo sapiens
  misc_feature: HEFZJCU01DF5HS.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggtttgactactggggccaggggaagcttggtcaccgtctcctcagcct

SEQ ID NO: 446811 - DNA, 537 bp, Homo sapiens
  misc_feature: HEFZJCU01ATVOF.49.10.A10.1.454.heavy.3.raw
agtcgagagacacgaccggtgctcgatttagcgtcgatctcaggggagctctgggagacgagcccagcactggaagtcgccggtgtttccattcggtgatcatcactgaacacagaggactcaccatggagtttgggttgagctgggttttcctcgctgctcttttaagagacgtccactgttttgtgggcctggtggagtctggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgttttgcggacacggctgtttattattgtgcgacgacgggggcccccctttcgaggagcgatcatactactttgaccactggggccgacgggaaccc

SEQ ID NO: 446812 - DNA, 436 bp, Homo sapiens
  misc_feature: HEFZJCU01CML9A.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggcccaaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 446813 - DNA, 396 bp, Homo sapiens; identical to SEQ ID NO: 444568
  misc_feature: HEFZJCU01EX9OL.47.46.E02.1.454.heavy.3.raw

SEQ ID NO: 446814 - DNA, 505 bp, Homo sapiens
  misc_feature: HEFZJCU01BF6ZM.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 446815 - DNA, 505 bp, Homo sapiens
  misc_feature: HEFZJCU01DWFHJ.49.78.H01.1.454.heavy.3.raw
agtcgagagacacgaccggtgctcgatttagtgtgagtagtttgggtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggccg

SEQ ID NO: 446816 - DNA, 492 bp, Homo sapiens; identical to SEQ ID NO: 445919
  misc_feature: HEFZJCU01DBFT4.14.25.C03.1.454.heavy.3.raw

SEQ ID NO: 446817 - DNA, 482 bp, Homo sapiens; identical to SEQ ID NO: 444904
  misc_feature: HEFZJCU01EDG3H.47.59.F04.1.454.heavy.3.raw

SEQ ID NO: 446818 - DNA, 525 bp, Homo sapiens
  misc_feature: HEFZJCU01EZHN5.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagcttccaccaagggcccatcggtcttccccg

SEQ ID NO: 446819 - DNA, 489 bp, Homo sapiens; identical to SEQ ID NO: 444591
  misc_feature: HEFZJCU01C40UO.18.70.G04.1.454.heavy.3.raw

SEQ ID NO: 446820 - DNA, 372 bp, Homo sapiens; identical to SEQ ID NO: 444513
  misc_feature: HEFZJCU01AN7Q8.5.23.C01.1.454.heavy.3.raw

SEQ ID NO: 446821 - DNA, 400 bp, Homo sapiens; identical to SEQ ID NO: 444452
  misc_feature: HEFZJCU01BEGL6.47.24.C02.1.454.heavy.3.raw

SEQ ID NO: 446822 - DNA, 371 bp, Homo sapiens; identical to SEQ ID NO: 444919
  misc_feature: HEFZJCU01AO249.3.1.A01.1.454.heavy.3.raw

SEQ ID NO: 446823 - DNA, 395 bp, Homo sapiens
  misc_feature: HEFZJCU01D8W1W.18.39.D06.1.454.heavy.3.raw
tacgagtatgcacgaccggtgctcgatttagtgacatctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 446824 - DNA, 398 bp, Homo sapiens; identical to SEQ ID NO: 444601
  misc_feature: HEFZJCU01ETC0D.4.79.H02.1.454.heavy.3.raw

SEQ ID NO: 446825 - DNA, 519 bp, Homo sapiens
  misc_feature: HEFZJCU01BAJRQ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggataccggtcacgaccccaggaaaggccctggagtggcttgcgctcatttattgggatgagagtaagcactacagtccgtctctgaagaacaggctcaccatcaccaaggacacctccaacaaaccaggtggtccttacaatgaccaatatggaccctgtggacacagccacatattactgttccacgctctatggttcggggagttattagtccctactttgactactggggccagggactctggtcaccgtctccgcagcctccaccaggcccatcc

SEQ ID NO: 446826 - DNA, 518 bp, Homo sapiens
  misc_feature: HEFZJCU01EK82G.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacga

SEQ ID NO: 446827 - DNA, 507 bp, Homo sapiens
  misc_feature: HEFZJCU01EZ3C4.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcgtggggccagggacg

SEQ ID NO: 446828 - DNA, 501 bp, Homo sapiens
  misc_feature: HEFZJCU01CII75.13.11.A11.1.454.heavy.3.raw
tcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgct

SEQ ID NO: 446829 - DNA, 520 bp, Homo sapiens
  misc_feature: HEFZJCU01CUUJ9.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaaatgaacagtctgagacctgaggacacggccttatatttctgtgcaaaagatcttggagctggccgtgaccactggggccagggaaccct

SEQ ID NO: 446830 - DNA, 379 bp, Homo sapiens; identical to SEQ ID NO: 444450
  misc_feature: HEFZJCU01B45BY.47.77.G11.1.454.heavy.3.raw

SEQ ID NO: 446831 - DNA, 580 bp, Homo sapiens
  misc_feature: HEFZJCU01D9RKX.5.33.C11.1.454.heavy.3.raw
atcagacacgcacgaccggtgctcgatttagagtgagctcgttgggtttggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcacgcctccaccgaacggcccagtcggtccttccccgtggccgccctgcctccgaggacgccaccctccgagacgccaacacggccggcccgtgggcctcgcccgtggtacgaaggaccttaccgttcccgttgtcctgtactcgtgacggccggggtcgtcggaccg

SEQ ID NO: 446832 - DNA, 517 bp, Homo sapiens
  misc_feature: HEFZJCU01ECHQK.14.66.F11.1.454.heavy.3.raw
cgtctagtaccacgaccggtgctcgatttagtcacgcgagaagggtgccagggggaagaccgatgggcccaggactggtgaagccttcggagaccctgtccctcacctgcactgtctctggcggctccatcaatacttacaactggacctggatccggcagcccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgagggtcggtggccacaatggcgagtacaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 446833 - DNA, 395 bp, Homo sapiens; identical to SEQ ID NO: 444517
  misc_feature: HEFZJCU01CFEX9.16.68.G02.1.454.heavy.3.raw

SEQ ID NO: 446834 - DNA, 371 bp, Homo sapiens; identical to SEQ ID NO: 444435
  misc_feature: HEFZJCU01EBCGR.3.42.D09.1.454.heavy.3.raw

SEQ ID NO: 446835 - DNA, 512 bp, Homo sapiens
  misc_feature: HEFZJCU01DE4JY.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 446836 - DNA, 526 bp, Homo sapiens
  misc_feature: HEFZJCU01AG298.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 446837 - DNA, 379 bp, Homo sapiens; identical to SEQ ID NO: 444676
  misc_feature: HEFZJCU01BARWU.47.77.G11.1.454.heavy.3.raw

SEQ ID NO: 446838 - DNA, 514 bp, Homo sapiens
  misc_feature: HEFZJCU01DXGKK.13.4.A04.1.454.heavy.3.raw
tcacgtactacacgaccggtgctcgatttagagtagtgatcaggggtctgagagaggagcccagccctgggattttcaggtgttttcatttggtgatcaggactgaacagagagaactcaccatggaatttgggctgagcgtggcgttttcttgtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttaccctatacttttgactactggggccaggggaa

SEQ ID NO: 446839 - DNA, 511 bp, Homo sapiens; identical to SEQ ID NO: 445840
  misc_feature: HEFZJCU01B4LPE.11.13.B02.1.454.heavy.3.raw

SEQ ID NO: 446840 - DNA, 511 bp, Homo sapiens
  misc_feature: HEFZJCU01D3L2T.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcacctggtcactgtctcctcggcttccaccaagggcccatcggtcttcccctggcgccctgctccaggacgcacctctggggcacagcgccg

SEQ ID NO: 446841 - DNA, 351 bp, Homo sapiens
  misc_feature: HEFZJCU01C4XLQ.13.23.C01.1.454.heavy.3.raw
tcacgtactacacgaccggtgctcgatttagtacacgtgattagggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 446842 - DNA, 518 bp, Homo sapiens; identical to SEQ ID NO: 444718
  misc_feature: HEFZJCU01CA252.9.34.D01.1.454.heavy.3.raw

SEQ ID NO: 446843 - DNA, 443 bp, Homo sapiens
  misc_feature: HEFZJCU01CHXZN.11.3.A03.1.454.heavy.3.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagccccccaaactcctcatagtatggtaacagcagttcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgcccctcggtcactctgttcccgccctcctcgtatctctcg

SEQ ID NO: 446844 - DNA, 500 bp, Homo sapiens
  misc_feature: HEFZJCU01BGL6G.10.28.C06.1.454.heavy.3.raw
catagtagtgcacgaccggtgctcgatttagagctcacgtattgggtttggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaaatagggtctacgattactcattctgactactggggccagggaaccctggtcaccgtctcctcagcctccaccaagggcccatcggtcttcccctggcgccctgctccaggagcacctccgagagcacagcggccctgggctgcctggtcaaggactacttcccactactatg

SEQ ID NO: 446845 - DNA, 523 bp, Homo sapiens
  misc_feature: HEFZJCU01C0482.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtggggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtactcctttgacgtctggggccac

SEQ ID NO: 446846 - DNA, 521 bp, Homo sapiens
  misc_feature: HEFZJCU01B88TW.49.15.B04.1.454.heavy.3.raw
agtcgagagacacgaccggtgctcgatttagacagtatatatccgcggggacactttctgagagtcctggacctcctgtgcaagaacatgaaacatctgtgggtcttccttctcctggtgacagctcccagatgggtcctgtcccaggtgcagctgcaggagtcgggcccaggactggtgaagccttcggagaccctgtccctcacctgcactgtctctggtggctccgttagtagttactattggagctgggtccggcagtcccccgggaagggactggaatggattggctatatctactacagtggaagcaccgattacaatccctccctcaagagtcgagtcagcatttcagccgacaggtccaagaaccagttctccctgaagttgaagtctgtgaccgctgcggacacggccgtgtatttctgtgcggttgatgattaccttcgggggactcatcgtactttcgacatctggggccgagggacaacagtcatcgtctcttcaacctccaccaaggg

SEQ ID NO: 446847 - DNA, 400 bp, Homo sapiens
  misc_feature: HEFZJCU01DM98U.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccgagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 446848 - DNA, 481 bp, Homo sapiens
  misc_feature: HEFZJCU01EJ92K.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctggctgcctggtcaaggactacttccgtatctctcg

SEQ ID NO: 446849 - DNA, 388 bp, Homo sapiens
  misc_feature: HEFZJCU01C98DA.49.53.E09.1.454.heavy.3.raw
agtcgagagacacgaccggtgctcgatttagagagagtgtgttgggtttgggtctggagtgggtctctcttattaattgggatggtggtatcaccgactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 446850 - DNA, 390 bp, Homo sapiens
  misc_feature: HEFZJCU01CCHOX.22.29.C07.1.454.heavy.3.raw
acatacgcgtcacgaccggtgctcgatttagagtgctacgaagggaaaggggctggagtgggtctcaggtattagtgataatgcttttagcacaaactacgcagactccgtgaagggccggttcaccatctccagagacaattccaagaacacgctgtatttgcaaatgaacagcctgagagccgaagacacggccgtctattactgtgcgagattaccgcatacggtgactacctactttctcgactggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 446851 - DNA, 497 bp, Homo sapiens
  misc_feature: HEFZJCU01BSA1B.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacc

SEQ ID NO: 446852 - DNA, 491 bp, Homo sapiens; identical to SEQ ID NO: 444592
  misc_feature: HEFZJCU01EVCIU.11.26.C04.1.454.heavy.3.raw

SEQ ID NO: 446853 - DNA, 520 bp, Homo sapiens
  misc_feature: HEFZJCU01AG5ZA.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtctcccctggcg

SEQ ID NO: 446854 - DNA, 527 bp, Homo sapiens; identical to SEQ ID NO: 446775
  misc_feature: HEFZJCU01DOXOA.9.78.H01.1.454.heavy.3.raw

SEQ ID NO: 446855 - DNA, 387 bp, Homo sapiens; identical to SEQ ID NO: 445170
  misc_feature: HEFZJCU01E1MK7.27.46.E02.1.454.heavy.3.raw

SEQ ID NO: 446856 - DNA, 511 bp, Homo sapiens; identical to SEQ ID NO: 445268
  misc_feature: HEFZJCU01DP0AQ.48.34.D01.1.454.heavy.3.raw

SEQ ID NO: 446857 - DNA, 531 bp, Homo sapiens
  misc_feature: HEFZJCU01DK579.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 446858 - DNA, 497 bp, Homo sapiens
  misc_feature: HEFZJCU01CVPS7.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctcctgcatttgcactctgtgactcccgacgacacggctgtctactattgtgtaagacatcccacagggggctccacactcgaccctggggccagggaaccctagtcaccgtctcctcagcctccaccaagggcccatcggtcttcccctggcgccctgctccagagcacctccgaga

SEQ ID NO: 446859 - DNA, 422 bp, Homo sapiens; identical to SEQ ID NO: 444681
  misc_feature: HEFZJCU01DV17Q.16.78.H01.1.454.heavy.3.raw

SEQ ID NO: 446860 - DNA, 522 bp, Homo sapiens
  misc_feature: HEFZJCU01EV7VY.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcatgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccagggggacaatggtcaccgtctcttcacg

SEQ ID NO: 446861 - DNA, 460 bp, Homo sapiens
  misc_feature: HEFZJCU01BO7T9.10.77.G11.1.454.heavy.3.raw
catagtagtgcacgaccggtgctcgatttagctagtcactcaagggaaagggtgtacacctgtggttctcggggctgccctttggctttggagatggttttctcgaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttcccctggcaccctcctccaagagcacctctgggggcacagcggccctgggctgcctggtcaaggactacttcccactactatg

SEQ ID NO: 446862 - DNA, 497 bp, Homo sapiens; identical to SEQ ID NO: 444995
  misc_feature: HEFZJCU01A89FO.4.26.C04.1.454.heavy.3.raw

SEQ ID NO: 446863 - DNA, 496 bp, Homo sapiens
  misc_feature: HEFZJCU01DUJWP.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtggggagaaatcctagtggc

SEQ ID NO: 446864 - DNA, 492 bp, Homo sapiens
  misc_feature: HEFZJCU01EYLYN.19.5.A05.1.454.heavy.3.raw
tactctcgtgcacgaccggtgctcgatttagatagatagacagggggtctccctcactgcccagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatgggaatcatctatcctggagactctgatgccagatacactccgtccttccaaggccgagtcaccatttcagccgacaagtccatcagcaccgcctacctgcagtggaacagcctgacggcctcggacagcggcgtctattactgtgcgagcattcaaaatgggtggcggcgagggtggttttgatttcgg

SEQ ID NO: 446865 - DNA, 506 bp, Homo sapiens; identical to SEQ ID NO: 446520
  misc_feature: HEFZJCU01C3SIY.10.38.D05.1.454.heavy.3.raw

SEQ ID NO: 446866 - DNA, 387 bp, Homo sapiens
  misc_feature: HEFZJCU01BOJQG.15.1.A01.1.454.heavy.3.raw
tctacgtagccacgaccggtgctcgatttagacgtctcatcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttccccctggcaccctcctccaagagcacctctgggggcacagcggccctgggctgcctggtcaaggactacttccgctacgtaga

SEQ ID NO: 446867 - DNA, 510 bp, Homo sapiens
  misc_feature: HEFZJCU01C25D8.49.68.G02.1.454.heavy.3.raw
agtcgagagacacgaccggtgctcgatttagtcgatagtgaagggaaaggggctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatcccg

SEQ ID NO: 446868 - DNA, 497 bp, Homo sapiens; identical to SEQ ID NO: 445413
  misc_feature: HEFZJCU01BURBR.16.37.D04.1.454.heavy.3.raw

SEQ ID NO: 446869 - DNA, 436 bp, Homo sapiens; identical to SEQ ID NO: 444686
  misc_feature: HEFZJCU01EPGPB.40.27.C05.1.454.heavy.3.raw

SEQ ID NO: 446870 - DNA, 409 bp, Homo sapiens
  misc_feature: HEFZJCU01CLVVL.49.77.G11.1.454.heavy.3.raw
agtcgagagacacgaccggtgctcgatttagctagtcactcaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 446871 - DNA, 392 bp, Homo sapiens; identical to SEQ ID NO: 444456
  misc_feature: HEFZJCU01BNLT0.7.60.F05.1.454.heavy.3.raw

SEQ ID NO: 446872 - DNA, 395 bp, Homo sapiens; identical to SEQ ID NO: 444517
  misc_feature: HEFZJCU01EGWIP.16.68.G02.1.454.heavy.3.raw

SEQ ID NO: 446873 - DNA, 535 bp, Homo sapiens
  misc_feature: HEFZJCU01EM3SQ.17.28.C06.1.454.heavy.3.raw
  modified_base (523)..(523): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccagggganccctggtcaccg

SEQ ID NO: 446874 - DNA, 510 bp, Homo sapiens
  misc_feature: HEFZJCU01DLL8Z.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggagcacctctgggggcacagcggccctgggctgcctggtcaaggactacttcccata

SEQ ID NO: 446875 - DNA, 507 bp, Homo sapiens
  misc_feature: HEFZJCU01EJLBK.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtccttcccctggccaccctcctccaagagcacctctgggggcacagcggccctgggctgcctggtcaaggactacttcctacgtcgtat

SEQ ID NO: 446876 - DNA, 438 bp, Homo sapiens
  misc_feature: HEFZJCU01BLYPM.40.27.C05.1.454.heavy.3.raw
  modified_base (138)..(138): a, c, t, g, unknown or other
tctagcgactcacgaccggtgctcgatttagacgcgatcgaagggtttggggctgggtccgccggcccccagggaaggggctggagtggattgcgagcatatattatgatgagagcgccctctacaaccccccccctntacaacccctccctcaagagtcgggtcaccatatctatagacacgtccaacagtcaattctccctggacttgacctctgtgaccgccgcagacacggctgtatattccctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 446877 - DNA, 405 bp, Homo sapiens
  misc_feature: HEFZJCU01B7153.14.42.D09.1.454.heavy.3.raw
cgtctagtaccacgaccggtgctcgatttagacacatacgcagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 446878 - DNA, 526 bp, Homo sapiens
  misc_feature: HEFZJCU01EB7HC.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 446879 - DNA, 519 bp, Homo sapiens; identical to SEQ ID NO: 444867
  misc_feature: HEFZJCU01C2MS0.9.34.D01.1.454.heavy.3.raw

SEQ ID NO: 446880 - DNA, 477 bp, Homo sapiens; identical to SEQ ID NO: 444659
  misc_feature: HEFZJCU01DHQSL.16.10.A10.1.454.heavy.3.raw

SEQ ID NO: 446881 - DNA, 397 bp, Homo sapiens
  misc_feature: HEFZJCU01ET4LA.12.72.G06.1.454.heavy.3.raw
atacgacgtacacgaccggtgctcgatttagctacgactgcaagggaaaggggctggagtgggtctcaggtattagtggaagtggagcaaccacatactacgcagactccgtaaagggccgattcaccatctccagagacaataccaacaacactctgtatctgcaactgaacggcctgagagccgaggacacggccctttattactgtgcgaaagatcgggtaactttagcagcggctggttactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 446882 - DNA, 481 bp, Homo sapiens; identical to SEQ ID NO: 444957
  misc_feature: HEFZJCU01BEPJS.19.67.G01.1.454.heavy.3.raw

SEQ ID NO: 446883 - DNA, 518 bp, Homo sapiens
  misc_feature: HEFZJCU01DSWE2.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctggactgcctggtcaaggactacttccagacgtatca

SEQ ID NO: 446884 - DNA, 482 bp, Homo sapiens; identical to SEQ ID NO: 445068
  misc_feature: HEFZJCU01BULAI.11.23.C01.1.454.heavy.3.raw

SEQ ID NO: 446885 - DNA, 496 bp, Homo sapiens; identical to SEQ ID NO: 444697
  misc_feature: HEFZJCU01BJUYC.16.37.D04.1.454.heavy.3.raw

SEQ ID NO: 446886 - DNA, 507 bp, Homo sapiens
  misc_feature: HEFZJCU01C6E62.49.25.C03.1.454.heavy.3.raw
  modified_base (473)..(473): a, c, t, g, unknown or other
agtcgagagacacgaccggtgctcgatttagtagtgtagatttgggtttgggctgagcgtggtttcgtcgttaggcgtcttttaagaggtgtccagtgtcatgtgcagttgatacagtctggggggaggcgtggtccagcctgggaggtccctgagactctcctgtgcagcctctggattcgtctctagtgtctaccctatgcactgggtccgccaggctccaggcaaggggctggaatggggtggcactttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagcctggtcaccgtctcctcngcttccaccaaggcccatcggtcttcccctggcg

SEQ ID NO: 446887 - DNA, 505 bp, Homo sapiens; identical to SEQ ID NO: 445664
  misc_feature: HEFZJCU01EE34K.12.33.C11.1.454.heavy.3.raw

SEQ ID NO: 446888 - DNA, 517 bp, Homo sapiens; identical to SEQ ID NO: 446039
  misc_feature: HEFZJCU01BIDZ5.9.70.G04.1.454.heavy.3.raw

SEQ ID NO: 446889 - DNA, 506 bp, Homo sapiens
  misc_feature: HEFZJCU01BTR5P.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctc

SEQ ID NO: 446890 - DNA, 508 bp, Homo sapiens; identical to SEQ ID NO: 446002
  misc_feature: HEFZJCU01D5DW9.9.78.H01.1.454.heavy.3.raw

SEQ ID NO: 446891 - DNA, 517 bp, Homo sapiens
  misc_feature: HEFZJCU01DMNHN.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatcc

SEQ ID NO: 446892 - DNA, 316 bp, Homo sapiens; identical to SEQ ID NO: 444444
  misc_feature: HEFZJCU01BRVNB.47.56.F01.1.454.heavy.3.raw

SEQ ID NO: 446893 - DNA, 495 bp, Homo sapiens; identical to SEQ ID NO: 445359
  misc_feature: HEFZJCU01C7N90.4.21.B10.1.454.heavy.3.raw

SEQ ID NO: 446894 - DNA, 525 bp, Homo sapiens
  misc_feature: HEFZJCU01C4R57.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgcccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagccctccaccaagggcccatcggtcttccccctggccg

SEQ ID NO: 446895 - DNA, 396 bp, Homo sapiens; identical to SEQ ID NO: 444469
  misc_feature: HEFZJCU01D8OQW.47.46.E02.1.454.heavy.3.raw

SEQ ID NO: 446896 - DNA, 502 bp, Homo sapiens
  misc_feature: HEFZJCU01CSZ55.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaagtggtcc

SEQ ID NO: 446897 - DNA, 500 bp, Homo sapiens; identical to SEQ ID NO: 444529
  misc_feature: HEFZJCU01AM954.12.38.D05.1.454.heavy.3.raw

SEQ ID NO: 446898 - DNA, 332 bp, Homo sapiens
  misc_feature: HEFZJCU01CN5FG.12.71.G05.1.454.heavy.3.raw
atacgacgtacacgaccggtgctcgatttagtgtcgtcgcaagagagagggggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttccccctggcgccctgctccaggagcacctccgagagcacagcggccctgggctgcctggtcaaggactacttcctacgtcgtat

SEQ ID NO: 446899 - DNA, 488 bp, Homo sapiens; identical to SEQ ID NO: 444617
  misc_feature: HEFZJCU01DCYDG.4.6.A06.1.454.heavy.3.raw

SEQ ID NO: 446900 - DNA, 514 bp, Homo sapiens
  misc_feature: HEFZJCU01DNQRD.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactc

SEQ ID NO: 446901 - DNA, 521 bp, Homo sapiens
  misc_feature: HEFZJCU01EI8V7.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggccaccctcctccaagagcacctctgggggcacacg

SEQ ID NO: 446902 - DNA, 489 bp, Homo sapiens; identical to SEQ ID NO: 444591
  misc_feature: HEFZJCU01C1LYI.18.70.G04.1.454.heavy.3.raw

SEQ ID NO: 446903 - DNA, 511 bp, Homo sapiens; identical to SEQ ID NO: 446808
  misc_feature: HEFZJCU01D3RXT.15.67.G01.1.454.heavy.3.raw

SEQ ID NO: 446904 - DNA, 518 bp, Homo sapiens; identical to SEQ ID NO: 445453
  misc_feature: HEFZJCU01ANAHI.9.34.D01.1.454.heavy.3.raw

SEQ ID NO: 446905 - DNA, 400 bp, Homo sapiens; identical to SEQ ID NO: 444452
  misc_feature: HEFZJCU01APUMY.47.24.C02.1.454.heavy.3.raw

SEQ ID NO: 446906 - DNA, 507 bp, Homo sapiens
  misc_feature: HEFZJCU01EX6B2.52.34.D01.1.454.heavy.3.raw
cgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 446907 - DNA, 519 bp, Homo sapiens; identical to SEQ ID NO: 444867
  misc_feature: HEFZJCU01DV8EG.9.34.D01.1.454.heavy.3.raw

SEQ ID NO: 446908 - DNA, 527 bp, Homo sapiens
  misc_feature: HEFZJCU01ARWJ8.12.40.D07.1.454.heavy.3.raw
atacgacgtacacgaccggtgctcgatttagtgatagagcgtaacaacagagggctcaccatggagtttgggctgagcggtcggtttcgtcgtaggcgtctttaagtaaggtgtcagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggggaccctggtcatcgtctccccagcctccaccaagggcccatcggtcttccccctggccg

SEQ ID NO: 446909 - DNA, 460 bp, Homo sapiens; identical to SEQ ID NO: 445837
  misc_feature: HEFZJCU01C3CRZ.10.77.G11.1.454.heavy.3.raw

SEQ ID NO: 446910 - DNA, 427 bp, Homo sapiens; identical to SEQ ID NO: 444708
  misc_feature: HEFZJCU01D5JL4.9.34.D01.1.454.heavy.3.raw

SEQ ID NO: 446911 - DNA, 499 bp, Homo sapiens
  misc_feature: HEFZJCU01CBPNU.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctcaccaagggcccatcggtcttcccctggcgccctgctccaggagcacctccgagagcacagcggccctgggctgcctggtcaaggactacttcctacgtcgtat

SEQ ID NO: 446912 - DNA, 505 bp, Homo sapiens
  misc_feature: HEFZJCU01ET52X.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcttacagcggccctgggctgcctggtcaaggactacttccagacgtatca

SEQ ID NO: 446913 - DNA, 477 bp, Homo sapiens
  misc_feature: HEFZJCU01CWILM.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctcggcaccctcctccaagagcacctctggggcacagcggccctgggctgcctggtcaaggactacttccgagtagtaca

SEQ ID NO: 446914 - DNA, 505 bp, Homo sapiens
  misc_feature: HEFZJCU01D1LD5.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctgtctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaacctcctatgtcttttgattatcgtcggggccaagggac

SEQ ID NO: 446915 - DNA, 496 bp, Homo sapiens
  misc_feature: HEFZJCU01B9XVZ.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggccctgggctgcctggtcaaggactacc

SEQ ID NO: 446916 - DNA, 371 bp, Homo sapiens; identical to SEQ ID NO: 444435
  misc_feature: HEFZJCU01DLV1N.3.42.D09.1.454.heavy.3.raw

SEQ ID NO: 446917 - DNA, 517 bp, Homo sapiens
  misc_feature: HEFZJCU01EA3LC.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactactccagacgtatca

SEQ ID NO: 446918 - DNA, 379 bp, Homo sapiens; identical to SEQ ID NO: 444773
  misc_feature: HEFZJCU01A0HC9.3.59.F04.1.454.heavy.3.raw

SEQ ID NO: 446919 - DNA, 512 bp, Homo sapiens
  misc_feature: HEFZJCU01DAS96.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattcccccttccagaattttgatatccattgggtgcgacaggccagtggacaagggctcgagtggatgggatggatgaacggtaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactacttcccatacc

SEQ ID NO: 446920 - DNA, 502 bp, Homo sapiens
  misc_feature: HEFZJCU01BEK4U.26.80.H03.1.454.heavy.3.raw
agactatactcacgaccggtgctcgatttagctgtgcgtcgaagggaaaggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaggggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgatgttttgattggtttttacg

SEQ ID NO: 446921 - DNA, 518 bp, Homo sapiens; identical to SEQ ID NO: 444718
  misc_feature: HEFZJCU01DT0UD.9.34.D01.1.454.heavy.3.raw

SEQ ID NO: 446922 - DNA, 395 bp, Homo sapiens
  misc_feature: HEFZJCU01CBFEB.17.61.F06.1.454.heavy.3.raw
cgtagactagcacgaccggtgctcgatttagctacgctctaagggaaggggctggagtgggtctcaactatcagtggtagtggtgttagcacatattacgcagactccgtgaagggccggttcaccatctccagagacaattccaagaacacgctgtatgttcaaatgaacagcctgagagccgaggacacggccgtatattactgtgcgaaagaccttgtgtatagcagtgcctggtaccaaggtgactactggggccagggaaccctggtcaccgtctcctcagcctccaccaagggcccatcggtcttccccctggcaccctcctccaagagcacctctgggggcacagcggccctgggctgcctggtcaaggactacttccctagtctacg

SEQ ID NO: 446923 - DNA, 477 bp, Homo sapiens; identical to SEQ ID NO: 444659
  misc_feature: HEFZJCU01DYQ18.16.10.A10.1.454.heavy.3.raw

SEQ ID NO: 446924 - DNA, 396 bp, Homo sapiens; identical to SEQ ID NO: 444469
  misc_feature: HEFZJCU01AR136.47.46.E02.1.454.heavy.3.raw

SEQ ID NO: 446925 - DNA, 537 bp, Homo sapiens
  misc_feature: HEFZJCU01B0WJI.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcctaccg

SEQ ID NO: 446926 - DNA, 504 bp, Homo sapiens
  misc_feature: HEFZJCU01D8708.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcgtcttcccctgcgcctgctcagagcactctggggcacagcgccg

SEQ ID NO: 446927 - DNA, 465 bp, Homo sapiens; identical to SEQ ID NO: 444805
  misc_feature: HEFZJCU01BI6FZ.19.10.A10.1.454.heavy.3.raw

SEQ ID NO: 446928 - DNA, 536 bp, Homo sapiens
  misc_feature: HEFZJCU01B64SS.48.28.C06.1.454.heavy.3.raw
agtatacatacacgaccggtgctcgatttagagctcacgtattgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgccgtttcctcagcctccaccaaggg

SEQ ID NO: 446929 - DNA, 514 bp, Homo sapiens
  misc_feature: HEFZJCU01EU86S.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcgtcttcccctggcaccctcctcc

SEQ ID NO: 446930 - DNA, 396 bp, Homo sapiens; identical to SEQ ID NO: 444469
  misc_feature: HEFZJCU01CRJ6U.47.46.E02.1.454.heavy.3.raw

SEQ ID NO: 446931 - DNA, 396 bp, Homo sapiens; identical to SEQ ID NO: 444469
  misc_feature: HEFZJCU01ETRFT.47.46.E02.1.454.heavy.3.raw

SEQ ID NO: 446932 - DNA, 496 bp, Homo sapiens; identical to SEQ ID NO: 445541
  misc_feature: HEFZJCU01DXQ4H.53.25.C03.1.454.heavy.3.raw

SEQ ID NO: 446933 - DNA, 488 bp, Homo sapiens; identical to SEQ ID NO: 444617
  misc_feature: HEFZJCU01DWI4Z.4.6.A06.1.454.heavy.3.raw

SEQ ID NO: 446934 - DNA, 519 bp, Homo sapiens
  misc_feature: HEFZJCU01EELOY.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactggggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactactcctagagacacg

SEQ ID NO: 446935 - DNA, 458 bp, Homo sapiens
  misc_feature: HEFZJCU01EW1ID.49.34.D01.1.454.heavy.3.raw
agtcgagagacacgaccggtgctcgatttagatcgtctgtgttgggtttggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446936 - DNA, 324 bp, Homo sapiens; identical to SEQ ID NO: 444475
  misc_feature: HEFZJCU01ETX62.18.17.B06.1.454.heavy.3.raw

SEQ ID NO: 446937 - DNA, 487 bp, Homo sapiens; identical to SEQ ID NO: 445077
  misc_feature: HEFZJCU01BWFEN.47.85.H08.1.454.heavy.3.raw

SEQ ID NO: 446938 - DNA, 396 bp, Homo sapiens
  misc_feature: HEFZJCU01BWFZ8.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgagggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 446939 - DNA, 493 bp, Homo sapiens
  misc_feature: HEFZJCU01CIS0V.4.21.B10.1.454.heavy.3.raw
agcactgtagcacgaccggtgctcgatttagtgtcgtcgcaagagaggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 446940 - DNA, 490 bp, Homo sapiens
  misc_feature: HEFZJCU01AHBVS.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaaggtacttcctacctatgct

SEQ ID NO: 446941 - DNA, 500 bp, Homo sapiens
  misc_feature: HEFZJCU01BC71X.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttgacagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaaggactacttcctagtacgtga

SEQ ID NO: 446942 - DNA, 399 bp, Homo sapiens
  misc_feature: HEFZJCU01CR30Z.16.80.H03.1.454.heavy.3.raw
tgtactactccacgaccggtgctcgatttagctgtgcgtcgaagggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtgaaagatttccgtggctactacgactactactacggtatggacgtctggggccaagggaccacggtcaccgtctcctcagcctccaccaagggcccatcggtcttccccctggcaccctcctccaagagcacctctggggcacagcggccctgggctgcctggtcaaggactatttccgagtagtaca

SEQ ID NO: 446943 - DNA, 518 bp, Homo sapiens
  misc_feature: HEFZJCU01DI2FL.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctgggctgcctggtcaaggactacttcctagagacacg

SEQ ID NO: 446944 - DNA, 481 bp, Homo sapiens
  misc_feature: HEFZJCU01D823F.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtctcccctggcgccctgctccaggagcacctccgagagcacagcggccctgggctgcctggtcaaggactacttcctacgtgagct

SEQ ID NO: 446945 - DNA, 483 bp, Homo sapiens; identical to SEQ ID NO: 444924
  misc_feature: HEFZJCU01AQZYL.10.35.D02.1.454.heavy.3.raw

SEQ ID NO: 446946 - DNA, 517 bp, Homo sapiens
  misc_feature: HEFZJCU01CHENS.48.34.D01.1.454.heavy.3.raw
agtatacatacacgaccggtgctcgatttagatcgtctgtgttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtata

SEQ ID NO: 446947 - DNA, 379 bp, Homo sapiens; identical to SEQ ID NO: 444450
  misc_feature: HEFZJCU01EZERZ.47.77.G11.1.454.heavy.3.raw

SEQ ID NO: 446948 - DNA, 492 bp, Homo sapiens
  misc_feature: HEFZJCU01D26CK.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 446949 - DNA, 495 bp, Homo sapiens
  misc_feature: HEFZJCU01EWBFZ.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctggctgcctggtcaaggactacttccgagtagtaca

SEQ ID NO: 446950 - DNA, 436 bp, Homo sapiens; identical to SEQ ID NO: 444686
  misc_feature: HEFZJCU01DECD9.40.27.C05.1.454.heavy.3.raw

SEQ ID NO: 446951 - DNA, 491 bp, Homo sapiens; identical to SEQ ID NO: 446104
  misc_feature: HEFZJCU01CK9SM.3.34.D01.1.454.heavy.3.raw

SEQ ID NO: 446952 - DNA, 517 bp, Homo sapiens
  misc_feature: HEFZJCU01CBSEV.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaaggcccatcggtcttcccctggcaccctcctccaagagcacctctgggggcacagcggccctgggctgcctggtcaaggactacttccgagtagtaca

SEQ ID NO: 446953 - DNA, 396 bp, Homo sapiens; identical to SEQ ID NO: 444426
  misc_feature: HEFZJCU01CF3AU.18.31.C09.1.454.heavy.3.raw

SEQ ID NO: 446954 - DNA, 491 bp, Homo sapiens
  misc_feature: HEFZJCU01DKOAK.17.16.B05.1.454.heavy.3.raw
cgtagactagcacgaccggtgctcgatttagagctcacgtattgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccgtctcctcagcctccaccaagggcccatccgtcttcccctggcgccctgctccaggagcacctccgagagcacagcggccctgggctgcctggtcaaggactacttccctagtctacg

SEQ ID NO: 446955 - DNA, 485 bp, Homo sapiens
  misc_feature: HEFZJCU01C6Q62.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccagagcacctccgagagcacagcggccctgggctgcctgtcaaggactactccatactcgta

SEQ ID NO: 446956 - DNA, 506 bp, Homo sapiens
  misc_feature: HEFZJCU01CKT5R.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgt

SEQ ID NO: 446957 - DNA, 519 bp, Homo sapiens; identical to SEQ ID NO: 444867
  misc_feature: HEFZJCU01BHYVH.9.34.D01.1.454.heavy.3.raw

SEQ ID NO: 446958 - DNA, 482 bp, Homo sapiens; identical to SEQ ID NO: 444503
  misc_feature: HEFZJCU01D0MEW.7.10.A10.1.454.heavy.3.raw

SEQ ID NO: 446959 - DNA, 400 bp, Homo sapiens; identical to SEQ ID NO: 444452
  misc_feature: HEFZJCU01B5J88.47.24.C02.1.454.heavy.3.raw

SEQ ID NO: 446960 - DNA, 489 bp, Homo sapiens
  misc_feature: HEFZJCU01EDVRS.51.69.G03.1.454.heavy.3.raw
cgatcgtatacacgaccggtgctcgatttagtcgctgcgtaaaggagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagacccctgt

SEQ ID NO: 446961 - DNA, 483 bp, Homo sapiens; identical to SEQ ID NO: 444924
  misc_feature: HEFZJCU01CND3P.10.35.D02.1.454.heavy.3.raw

SEQ ID NO: 446962 - DNA, 407 bp, Homo sapiens
  misc_feature: HEFZJCU01AC1S3.49.43.D10.1.454.heavy.3.raw
agtcgagagacacgaccggtgctcgatttagactagcagtaaggggctggagtgggtctctgccattagtggaagtggtgatctcagatactacggagactccgtgaagggccggttcaccatctccagagacaactccaagaatacgctctatctacacatgaaaacctaagagccgacgacacggccgtctattactgtgcaaagtgggtcacggactacgatgatactagtggctattactccggtgactactttgactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 446963 - DNA, 374 bp, Homo sapiens; identical to SEQ ID NO: 444640
  misc_feature: HEFZJCU01EI46Q.7.37.D04.1.454.heavy.3.raw

SEQ ID NO: 446964 - DNA, 489 bp, Homo sapiens
  misc_feature: HEFZJCU01BLP1R.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcgcccgtgggctgcctggtcaaggactacttcccatactcgta

SEQ ID NO: 446965 - DNA, 385 bp, Homo sapiens; identical to SEQ ID NO: 444438
  misc_feature: HEFZJCU01EOFE9.18.60.F05.1.454.heavy.3.raw

SEQ ID NO: 446966 - DNA, 516 bp, Homo sapiens
  misc_feature: HEFZJCU01ENSKL.49.81.H04.1.454.heavy.3.raw
agtcgagagacacgaccggtgctcgatttagtagtgtagattcgcgggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggagtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtgaccccgtcactcggtacggacg

SEQ ID NO: 446967 - DNA, 384 bp, Homo sapiens
  misc_feature: HEFZJCU01D0A0P.13.42.D09.1.454.heavy.3.raw
tcacgtactacacgaccggtgctcgatttagacacatacgcagggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 446968 - DNA, 381 bp, Homo sapiens
  misc_feature: HEFZJCU01D7G1K.8.34.D01.1.454.heavy.3.raw
ctcgcgtgtccacgaccggtgctcgatttagatcgtctgtgtgggtggcagttgtttcacctgagggcggtgttcaatggtatgcagactccgtgaagggccgattcaccatctccagagacaattccaggaacacaatgtatttggagctgaacagcctaagtcctgaggacacgggcgtatactactgtacgaaggagggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 446969 - DNA, 498 bp, Homo sapiens
  misc_feature: HEFZJCU01EB677.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccagcccggccccttacg

SEQ ID NO: 446970 - DNA, 529 bp, Homo sapiens
  misc_feature: HEFZJCU01CPEE4.48.70.G04.1.454.heavy.3.raw
agtatacatacacgaccggtgctcgatttagtgtagtgtgaagggaaagggggaacacagaggactcaccatggagtttgggctgagctggattttccttgctgctattttaaaaggtgtccagtgtgaggtgcagctggtgcagtccgggggggcctggtaccgcctggggggtcccttagactctcctgtgcagcctctggattcatcttcagtaatgtctggatgacctggttccgccaggctccagggaagggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatccggtccttcccctggccgccctcg

SEQ ID NO: 446971 - DNA, 397 bp, Homo sapiens
  misc_feature: HEFZJCU01DY6G8.18.61.F06.1.454.heavy.3.raw
tacgagtatgcacgaccggtgctcgatttagctacgctctaagggaaaggggctgggagtggttgagttttatatcatatgatggaggttacaaatattatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagagcacagcggccctgggctgcctggtcaaggactacttcccatactcgta

SEQ ID NO: 446972 - DNA, 380 bp, Homo sapiens
  misc_feature: HEFZJCU01BIDN7.3.26.C04.1.454.heavy.3.raw
agacgcactccacgaccggtgctcgatttagtctagcgactttgggtttgggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagactctggggtggctacgagtactggtacttcgatctctggggccgtggcaccctgcttactgtctcctcagcctccaccaagggcccatcggtcttccccctggcgccctgctccaggagcacctccgagagcacagcggccctgggctgcctggtcaaggactacttccgagtgcgtct

SEQ ID NO: 446973 - DNA, 337 bp, Homo sapiens
  misc_feature: HEFZJCU01DXKHV.52.58.F03.1.454.heavy.3.raw
cgcagtacgacacgaccggtgctcgatttagtctgatcgagaagggccggtgcaccatctccagagacaattcgaaggacactctatacctgcaactcaacagactgacacccgcggacacggccgtctattactgtgtaaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctatacgatcg

SEQ ID NO: 446974 - DNA, 502 bp, Homo sapiens
  misc_feature: HEFZJCU01DMAQ6.16.73.G07.1.454.heavy.3.raw
tgtactactccacgaccggtgctcgatttagctctacgctcaggggtccgggagatcatgagggtgtccttgagtctgggggaggcgtggtccagcctggggggtcgctgagactctcctgtgcagcctctggattcaccttcagtacctatgccatacactgggtccgccagcctccaggcaaggggctggagtgggtggctcttatatcatctgatggaggtactgaatactacgcagactccgtgaagggccgattcaccatctccagagacaattcccagaacacactgtatctgcaaatgaacagcctgagaactgaggacacggctctatattactgtgcgagaggggggccggtgggagctcctccacggggccatgactcctggggccagggatccctggtcaccgtctcctcagcctccaccaagggcccatcggtcttcccctggcgccctgctccaggagcacctccgagagcacagcggccctgggcctg

SEQ ID NO: 446975 - DNA, 515 bp, Homo sapiens
  misc_feature: HEFZJCU01EHXPZ.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgacgcagacacggccgtgtattactgtgcgagactggccgcaacagactacggtggcaactcctatgcttttgatatctggggccaagggacaatggtcaccgtctcttcagcctccaccaagggcccatcggtcttcccctggcaccctcctccaagagcacctctgggggcacagcggcccg

SEQ ID NO: 446976 - DNA, 470 bp, Homo sapiens; identical to SEQ ID NO: 444866
  misc_feature: HEFZJCU01AMLLQ.4.36.D03.1.454.heavy.3.raw

SEQ ID NO: 446977 - DNA, 532 bp, Homo sapiens
  misc_feature: HEFZJCU01AZ7JR.7.78.H01.1.454.heavy.3.raw
cgtgtctctacacgaccggtgctcgatttagtgtgagtagtttgggtttggggacccaacaaccacaccccctcctaagaagaacgccctagaccacagctccacaccatggactggacctggaggatcctcttcttggtggcagtagcaacaggtgcccactcccaggtgcagctggtacagtctgggtctgaattgaggaagccgtggggcgtcagtgagcgttgcctgcaagccttctggatacatcttcactacttattctgtcaattgggtccgacaggcccctggacaaggccttgactacatgggatggatcaacaccgacactgggaaccccacctatcgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccacca

SEQ ID NO: 446978 - DNA, 515 bp, Homo sapiens
  misc_feature: HEFZJCU01BOVHQ.11.23.C01.1.454.heavy.3.raw
  modified_base (484)..(484): a, c, t, g, unknown or other
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctctnagcgggcggtcggcgacggacggccgacagt

SEQ ID NO: 446979 - DNA, 495 bp, Homo sapiens
  misc_feature: HEFZJCU01DR9TN.19.59.F04.1.454.heavy.3.raw
  modified_base (487)..(487): a, c, t, g, unknown or other
tactctcgtgcacgaccggtgctcgatttagtacacacacttagggattgggggccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaagggctggagtgggtttcatacattagtagtagtggtagtagcatatactacgcagactctgtgaagggccgattcaccatctccagagacagcgccaagaactcactgtatctgcaaatgaacagcctgagagccgaggacacggcagtttatactgtgcgagagagtggcaagtgagggtcganattgtagt

SEQ ID NO: 446980 - DNA, 489 bp, Homo sapiens; identical to SEQ ID NO: 444591
  misc_feature: HEFZJCU01BVPCJ.18.70.G04.1.454.heavy.3.raw

SEQ ID NO: 446981 - DNA, 506 bp, Homo sapiens; identical to SEQ ID NO: 444696
  misc_feature: HEFZJCU01C6CQ6.16.34.D01.1.454.heavy.3.raw

SEQ ID NO: 446982 - DNA, 500 bp, Homo sapiens; identical to SEQ ID NO: 445080
  misc_feature: HEFZJCU01D5Y5T.3.81.H04.1.454.heavy.3.raw

SEQ ID NO: 446983 - DNA, 528 bp, Homo sapiens
  misc_feature: HEFZJCU01C4HZ9.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctgggggccaggggaaccctggtcaccgtctcctcagcctccaccg

SEQ ID NO: 446984 - DNA, 427 bp, Homo sapiens; identical to SEQ ID NO: 444708
  misc_feature: HEFZJCU01EHXHL.9.34.D01.1.454.heavy.3.raw

SEQ ID NO: 446985 - DNA, 519 bp, Homo sapiens
  misc_feature: HEFZJCU01DHHC8.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaacttcaacctgacgacactgccgtttatttttgtacgagagcgtcgtctgtcagtggaattgactactggggccagggaaccctggtcaccgtctcctcagcctccaccaagggcccatcggtcttcccctggccaccctcctccaagagcacctctgggggcacagcggccctgggctgcctggtcaaggactacttcctagagacacg

SEQ ID NO: 446986 - DNA, 511 bp, Homo sapiens
  misc_feature: HEFZJCU01BB1XH.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccac

SEQ ID NO: 446987 - DNA, 309 bp, Homo sapiens; identical to SEQ ID NO: 445000
  misc_feature: HEFZJCU01B3L9J.7.14.B03.1.454.heavy.3.raw

SEQ ID NO: 446988 - DNA, 524 bp, Homo sapiens
  misc_feature: HEFZJCU01EAWEW.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 446989 - DNA, 511 bp, Homo sapiens; identical to SEQ ID NO: 445840
  misc_feature: HEFZJCU01ET0X7.11.13.B02.1.454.heavy.3.raw

SEQ ID NO: 446990 - DNA, 396 bp, Homo sapiens
  misc_feature: HEFZJCU01C27FN.51.70.G04.1.454.heavy.3.raw
cgatcgtatacacgaccggtgctcgatttagtgtagtgtgaagggaaaggggctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 446991 - DNA, 516 bp, Homo sapiens
  misc_feature: HEFZJCU01EIMYW.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctcggcaccctcctccaagagcacctctgggggcacagcggcccg

SEQ ID NO: 446992 - DNA, 506 bp, Homo sapiens
  misc_feature: HEFZJCU01CXT1B.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctgggggcacagcggccctgggctgcctggtcaaggactacttccgta

SEQ ID NO: 446993 - DNA, 400 bp, Homo sapiens; identical to SEQ ID NO: 444452
  misc_feature: HEFZJCU01BX3K3.47.24.C02.1.454.heavy.3.raw

SEQ ID NO: 446994 - DNA, 507 bp, Homo sapiens
  misc_feature: HEFZJCU01D84JP.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggtacttcgtggggtccac

SEQ ID NO: 446995 - DNA, 386 bp, Homo sapiens
  misc_feature: HEFZJCU01BZ3Z3.49.21.B10.1.454.heavy.3.raw
agtcgagagacacgaccggtgctcgatttagtgtcgtcgcaagggtctggactgggtggcaggtatatcagctgatgggaccaaaatatactacgcaaactccgtgaagggccgattcaccatatcaagagacacttccgatgacacaatctatctgcaaatgaacagcctgaatttgacgacacgggtcttttttactgtgcgcctggaagcagtggctggccacatgatgcttttgatgtctggagccaagggacaatggtcatcgtctccccggcctccaccaagggcccatcggtcttccccctggcaccctcctccaagagcacctctgggggcacagcggccctgggctgcctggtcaaggactacttcctctctcgact

SEQ ID NO: 446996 - DNA, 437 bp, Homo sapiens; identical to SEQ ID NO: 444603
  misc_feature: HEFZJCU01CSBLR.3.21.B10.1.454.heavy.3.raw

SEQ ID NO: 446997 - DNA, 512 bp, Homo sapiens; identical to SEQ ID NO: 445688
  misc_feature: HEFZJCU01ESCR4.3.34.D01.1.454.heavy.3.raw

SEQ ID NO: 446998 - DNA, 437 bp, Homo sapiens; identical to SEQ ID NO: 444603
  misc_feature: HEFZJCU01ESMAM.3.21.B10.1.454.heavy.3.raw

SEQ ID NO: 446999 - DNA, 519 bp, Homo sapiens
  misc_feature: HEFZJCU01CUK7H.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccaggggaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctc

SEQ ID NO: 447000 - DNA, 422 bp, Homo sapiens; identical to SEQ ID NO: 444734
  misc_feature: HEFZJCU01AHE3S.16.78.H01.1.454.heavy.3.raw

SEQ ID NO: 447001 - DNA, 325 bp, Homo sapiens
  misc_feature: HEFZJCU01ATF1X.47.38.D05.1.454.heavy.3.raw
agctcacgtacacgaccggtgctcgatttagtatctgatagttgggtttgggtgcccaagctgctggagggcacggtcaccacgctgctgagcagtctgagacctcgacgacacggccgtgtattattgtgcgttaggttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 447002 - DNA, 503 bp, Homo sapiens
  misc_feature: HEFZJCU01AM79W.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacaagatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 447003 - DNA, 523 bp, Homo sapiens
  misc_feature: HEFZJCU01CO1X5.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggtattaccttgacacttggggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 447004 - DNA, 482 bp, Homo sapiens; identical to SEQ ID NO: 444503
  misc_feature: HEFZJCU01DTFZO.7.10.A10.1.454.heavy.3.raw

SEQ ID NO: 447005 - DNA, 492 bp, Homo sapiens
  misc_feature: HEFZJCU01AM37J.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatgacctc

SEQ ID NO: 447006 - DNA, 522 bp, Homo sapiens
  misc_feature: HEFZJCU01EKDFL.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgcctgctcagagcacctccgagagcacagcggccctgggc

SEQ ID NO: 447007 - DNA, 405 bp, Homo sapiens
  misc_feature: HEFZJCU01AEABP.53.41.D08.1.454.heavy.3.raw
cgcgtatacacacgaccggtgctcgatttagtcacgcgagaaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccatttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 447008 - DNA, 517 bp, Homo sapiens
  misc_feature: HEFZJCU01EVT9H.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctgcgccctgctccagagcacctccgagagcacagcggcctgggctgcctggtcaaggactacttctacg

SEQ ID NO: 447009 - DNA, 396 bp, Homo sapiens
  misc_feature: HEFZJCU01DHLVN.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaaccctggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 447010 - DNA, 491 bp, Homo sapiens
  misc_feature: HEFZJCU01BVEFK.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 447011 - DNA, 516 bp, Homo sapiens
  misc_feature: HEFZJCU01BZ7KL.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttccccctggcaccctcctccaagagcacctctgggggcacagcggcccg

SEQ ID NO: 447012 - DNA, 374 bp, Homo sapiens
  misc_feature: HEFZJCU01EQC45.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggcgccctgatccaggagcacctccgagagcacagcggccctgggctgcctggtcaaggactacttcctagagacacg

SEQ ID NO: 447013 - DNA, 314 bp, Homo sapiens; identical to SEQ ID NO: 444774
  misc_feature: HEFZJCU01EL28B.7.10.A10.1.454.heavy.3.raw

SEQ ID NO: 447014 - DNA, 492 bp, Homo sapiens
  misc_feature: HEFZJCU01BQVP2.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggcctgcctggtcaagggactacttcccatacctcgta

SEQ ID NO: 447015 - DNA, 518 bp, Homo sapiens
  misc_feature: HEFZJCU01AYQNR.14.4.A04.1.454.heavy.3.raw
cgtctagtaccacgaccggtgctcgatttagagtagtgatcagggggagagaggagcccagccctgggattttcaggtgttttcatttggtgatcaggactgaacagagagaactcaccatggaatttgggctgagcggtgcgtttctaggtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggt

SEQ ID NO: 447016 - DNA, 483 bp, Homo sapiens; identical to SEQ ID NO: 444924
  misc_feature: HEFZJCU01EQL9T.10.35.D02.1.454.heavy.3.raw

SEQ ID NO: 447017 - DNA, 500 bp, Homo sapiens
  misc_feature: HEFZJCU01CGWXG.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaaggactacttcctagtacgtga

SEQ ID NO: 447018 - DNA, 437 bp, Homo sapiens
  misc_feature: HEFZJCU01ES25H.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 447019 - DNA, 501 bp, Homo sapiens
  misc_feature: HEFZJCU01ASTLC.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactgaggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 447020 - DNA, 499 bp, Homo sapiens
  misc_feature: HEFZJCU01CO3K8.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgct

SEQ ID NO: 447021 - DNA, 513 bp, Homo sapiens
  misc_feature: HEFZJCU01BIUAY.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcggccctgggctgcctggtcaggactactt

SEQ ID NO: 447022 - DNA, 532 bp, Homo sapiens
  misc_feature: HEFZJCU01BM9WP.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatccggtcttccccctggccaccctcctcc

SEQ ID NO: 447023 - DNA, 503 bp, Homo sapiens
  misc_feature: HEFZJCU01CBRVM.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgtt

SEQ ID NO: 447024 - DNA, 504 bp, Homo sapiens; identical to SEQ ID NO: 445353
  misc_feature: HEFZJCU01AIEAX.10.38.D05.1.454.heavy.3.raw

SEQ ID NO: 447025 - DNA, 519 bp, Homo sapiens; identical to SEQ ID NO: 445330
  misc_feature: HEFZJCU01D3FA6.7.78.H01.1.454.heavy.3.raw

SEQ ID NO: 447026 - DNA, 482 bp, Homo sapiens
  misc_feature: HEFZJCU01EJI9K.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcttagagacacg

SEQ ID NO: 447027 - DNA, 515 bp, Homo sapiens
  misc_feature: HEFZJCU01DTOIU.9.28.C06.1.454.heavy.3.raw
tgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattaccaaggacacctccaaaaaccaggtggtccttacaatgaccaacatggaccctgtggacacagccacatattactgtgcacacagtgtcatgactgcggtgactgttctcccctttggctactggggccagggaaccctggtcaccgtctcctcagcctccaccaagggccacg

SEQ ID NO: 447028 - DNA, 522 bp, Homo sapiens
  misc_feature: HEFZJCU01DE9XG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggaccctggtcatcgtctccccagcctccaccaagggcccatccggtcttccccctggcg

SEQ ID NO: 447029 - DNA, 419 bp, Homo sapiens; identical to SEQ ID NO: 445646
  misc_feature: HEFZJCU01BMRSL.11.37.D04.1.454.heavy.3.raw

SEQ ID NO: 447030 - DNA, 521 bp, Homo sapiens
  misc_feature: HEFZJCU01DV4RY.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaacctggtcaccgtctcctcagcctcc

SEQ ID NO: 447031 - DNA, 536 bp, Homo sapiens
  misc_feature: HEFZJCU01CVYYI.48.43.D10.1.454.heavy.3.raw
agtatacatacacgaccggtgctcgatttagactagcagtaagggggtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccagggaaaactggtcaccgtctcctcagcttccaccaagggcccatcggtcttcccctcggcgccctcg

SEQ ID NO: 447032 - DNA, 405 bp, Homo sapiens
  misc_feature: HEFZJCU01CGYB9.52.87.H10.1.454.heavy.3.raw
cgcagtacgacacgaccggtgctcgatttagcagtactgcgttgggtttgggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 447033 - DNA, 482 bp, Homo sapiens; identical to SEQ ID NO: 444503
  misc_feature: HEFZJCU01BUBVN.7.10.A10.1.454.heavy.3.raw

SEQ ID NO: 447034 - DNA, 520 bp, Homo sapiens
  misc_feature: HEFZJCU01D90UF.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtacac

SEQ ID NO: 447035 - DNA, 529 bp, Homo sapiens
  misc_feature: HEFZJCU01DLMOC.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttcccctggcaccctcctcc

SEQ ID NO: 447036 - DNA, 519 bp, Homo sapiens; identical to SEQ ID NO: 444867
  misc_feature: HEFZJCU01BWLXC.9.34.D01.1.454.heavy.3.raw

SEQ ID NO: 447037 - DNA, 512 bp, Homo sapiens
  misc_feature: HEFZJCU01C43AO.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctcaccaagggccc

SEQ ID NO: 447038 - DNA, 436 bp, Homo sapiens
  misc_feature: HEFZJCU01C24CI.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccctctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 447039 - DNA, 519 bp, Homo sapiens
  misc_feature: HEFZJCU01EX8GH.51.85.H08.1.454.heavy.3.raw
cgatcgtatacacgaccggtgctcgatttagtatcactcagtcgcggggcggggggaagaggaagactgacggtcctcccaggagttcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaacacgctgtatctccaaatgaacagcctcagatctgaggacacggctatctactactgtgtgaagaattgggtttcagtggctactttgacttctggggccagggaaccctggtcaccgtctcctcagcttccaccaagggcccatcggtcttcccctggcgccctgctccaggagcacctcgtcgggggcacagcggcccgtc

SEQ ID NO: 447040 - DNA, 395 bp, Homo sapiens
  misc_feature: HEFZJCU01AWREV.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggctacttcctacgtgagct

SEQ ID NO: 447041 - DNA, 516 bp, Homo sapiens; identical to SEQ ID NO: 444848
  misc_feature: HEFZJCU01C6VFP.9.34.D01.1.454.heavy.3.raw

SEQ ID NO: 447042 - DNA, 339 bp, Homo sapiens
  misc_feature: HEFZJCU01BHMFO.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgtgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 447043 - DNA, 507 bp, Homo sapiens
  misc_feature: HEFZJCU01D694T.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 447044 - DNA, 488 bp, Homo sapiens
  misc_feature: HEFZJCU01BCNSQ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaggactacttcccatactcgta

SEQ ID NO: 447045 - DNA, 500 bp, Homo sapiens; identical to SEQ ID NO: 445028
  misc_feature: HEFZJCU01A8STD.13.12.B01.1.454.heavy.3.raw

SEQ ID NO: 447046 - DNA, 528 bp, Homo sapiens
  misc_feature: HEFZJCU01D8IRU.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagcccgcggacacgggcgtttattactgtgcgagaggggacggactacggtgactactgggggttcgacccctggggccagggaaccctggtcaccgtctcctcagcctccaccg

SEQ ID NO: 447047 - DNA, 492 bp, Homo sapiens; identical to SEQ ID NO: 446191
  misc_feature: HEFZJCU01C47TS.11.38.D05.1.454.heavy.3.raw

SEQ ID NO: 447048 - DNA, 395 bp, Homo sapiens
  misc_feature: HEFZJCU01DZZ5P.48.60.F05.1.454.heavy.3.raw
agtatacatacacgaccggtgctcgatttagtacgtcatcagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 447049 - DNA, 480 bp, Homo sapiens; identical to SEQ ID NO: 445011
  misc_feature: HEFZJCU01DK80S.22.36.D03.1.454.heavy.3.raw

SEQ ID NO: 447050 - DNA, 493 bp, Homo sapiens
  misc_feature: HEFZJCU01BSTIX.10.71.G05.1.454.heavy.3.raw
catagtagtgcacgaccggtgctcgatttagtgtcgtcgcaagagagaggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtctcttcggcctccaccaagggcccatcggtcttcccctggcgccctgctccaggagcacctccgagagcacagcggccctgggctgcctggtcaaggactacttcccactactatg

SEQ ID NO: 447051 - DNA, 313 bp, Homo sapiens; identical to SEQ ID NO: 444518
  misc_feature: HEFZJCU01AZ67A.7.10.A10.1.454.heavy.3.raw

SEQ ID NO: 447052 - DNA, 324 bp, Homo sapiens; identical to SEQ ID NO: 444475
  misc_feature: HEFZJCU01CGZSJ.18.17.B06.1.454.heavy.3.raw

SEQ ID NO: 447053 - DNA, 506 bp, Homo sapiens
  misc_feature: HEFZJCU01EGYA6.12.79.H02.1.454.heavy.3.raw
  modified_base (499)..(499): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaattttcgttattgttctggtggtgtgtgttcaatgtttnaccattc

SEQ ID NO: 447054 - DNA, 500 bp, Homo sapiens
  misc_feature: HEFZJCU01ET37J.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtgggg

SEQ ID NO: 447055 - DNA, 529 bp, Homo sapiens
  misc_feature: HEFZJCU01ETBFS.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatggaaccccggtcaccgt

SEQ ID NO: 447056 - DNA, 423 bp, Homo sapiens; identical to SEQ ID NO: 444772
  misc_feature: HEFZJCU01BMB0F.16.78.H01.1.454.heavy.3.raw

SEQ ID NO: 447057 - DNA, 519 bp, Homo sapiens
  misc_feature: HEFZJCU01D85MX.9.63.F08.1.454.heavy.3.raw
tgatacgtctcacgaccggtgctcgatttagcgatcgtataagggttgatccagcccagccataggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaaggcccatcggtcttcccctggcaccctcctccaagagcacctctgggggcacacg

SEQ ID NO: 447058 - DNA, 520 bp, Homo sapiens
  misc_feature: HEFZJCU01A6ZT2.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctcgtgggggcacagcggccctgggctgcctggtcaaggactacttccagacgtatca

SEQ ID NO: 447059 - DNA, 482 bp, Homo sapiens
  misc_feature: HEFZJCU01C85KV.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctgcaccctcctccaagagcacctctgggggcacagcggccctgggctgcctggtcaaggactacttccgtatctctcg

SEQ ID NO: 447060 - DNA, 427 bp, Homo sapiens; identical to SEQ ID NO: 444708
  misc_feature: HEFZJCU01CVF5J.9.34.D01.1.454.heavy.3.raw

SEQ ID NO: 447061 - DNA, 379 bp, Homo sapiens; identical to SEQ ID NO: 444450
  misc_feature: HEFZJCU01A0HKL.47.77.G11.1.454.heavy.3.raw

SEQ ID NO: 447062 - DNA, 539 bp, Homo sapiens
  misc_feature: HEFZJCU01EW4HG.16.39.D06.1.454.heavy.3.raw
tgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggccctggggccagggaaccgtggtcaccgtctcctcagcctccaccaac

SEQ ID NO: 447063 - DNA, 395 bp, Homo sapiens; identical to SEQ ID NO: 444517
  misc_feature: HEFZJCU01CKOUZ.16.68.G02.1.454.heavy.3.raw

SEQ ID NO: 447064 - DNA, 315 bp, Homo sapiens; identical to SEQ ID NO: 444422
  misc_feature: HEFZJCU01BNYEQ.47.84.H07.1.454.heavy.3.raw

SEQ ID NO: 447065 - DNA, 504 bp, Homo sapiens
  misc_feature: HEFZJCU01A7IMG.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttcccctggcgccctgctccaggagcacctccgagagcacagcggccctgggctgcctggtcaaggactacttcccactactatg

SEQ ID NO: 447066 - DNA, 491 bp, Homo sapiens
  misc_feature: HEFZJCU01BO4DV.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaggactacttccgtatctctcg

SEQ ID NO: 447067 - DNA, 532 bp, Homo sapiens
  misc_feature: HEFZJCU01DWHML.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgaggaaaagtatggctgtgtttagttggggccagggagccctggtcaccg

SEQ ID NO: 447068 - DNA, 512 bp, Homo sapiens
  misc_feature: HEFZJCU01BM6YY.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagcgtgggtttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgttcttcaatgaacagcctgagagccgatgacacggccgtgtattactgtgcgagagatggggcccacgaacgttactacgctatggacgtcgtggggaccg

SEQ ID NO: 447069 - DNA, 400 bp, Homo sapiens
  misc_feature: HEFZJCU01A009X.51.68.G02.1.454.heavy.3.raw
cgatcgtatacacgaccggtgctcgatttagtcgatagtgaagggaaaggggctggaatgggtggcagttatttcgtccactggaaacagtaaacattatggacgctccgtgaagggcccattcgccatctccagagacaattccaaaataccctctatctgcgaatgaacagcctgcgacctgaagacacggctatatatttctgtgcgagaggggagtcttattgtaatgatggttcctgctatcgtttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 447070 - DNA, 481 bp, Homo sapiens; identical to SEQ ID NO: 445517
  misc_feature: HEFZJCU01C46O6.22.36.D03.1.454.heavy.3.raw

SEQ ID NO: 447071 - DNA, 490 bp, Homo sapiens
  misc_feature: HEFZJCU01BIDEV.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcgccctgggctgcctggtcaaggactacttcccacgagagta

SEQ ID NO: 447072 - DNA, 373 bp, Homo sapiens; identical to SEQ ID NO: 445918
  misc_feature: HEFZJCU01B1R7D.49.30.C08.1.454.heavy.3.raw

SEQ ID NO: 447073 - DNA, 550 bp, Homo sapiens
  misc_feature: HEFZJCU01CMA1M.49.35.D02.1.454.heavy.3.raw
agtcgagagacacgaccggtgctcgatttagcacacgatagttgggtttgggtatagacttgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggtttggatgactcttacttctacttctacgttatggacctctggggccaagggaccacggtcaccgtctcctcagcctccaccaagggcccatcggtcttccccctggcaccctcctccaagagcacctctgggggcacg

SEQ ID NO: 447074 - DNA, 515 bp, Homo sapiens
  misc_feature: HEFZJCU01EFD8R.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccttcagcactggggccga

SEQ ID NO: 447075 - DNA, 396 bp, Homo sapiens; identical to SEQ ID NO: 444433
  misc_feature: HEFZJCU01DOMH6.47.59.F04.1.454.heavy.3.raw

SEQ ID NO: 447076 - DNA, 505 bp, Homo sapiens
  misc_feature: HEFZJCU01BKEMW.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 447077 - DNA, 533 bp, Homo sapiens
  misc_feature: HEFZJCU01D2WB4.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctggggcac

SEQ ID NO: 447078 - DNA, 487 bp, Homo sapiens
  misc_feature: HEFZJCU01D8LI0.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattactacgatagtta

SEQ ID NO: 447079 - DNA, 516 bp, Homo sapiens
  misc_feature: HEFZJCU01CF6U0.19.86.H09.1.454.heavy.3.raw
tactctcgtgcacgaccggtgctcgattagtgctatagacttgggtttggggggaagaggaagactgacggtcccactcccagatgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtctcccctggcgccctgctccaggagcacctccgagagcacagcggccctc

SEQ ID NO: 447080 - DNA, 396 bp, Homo sapiens; identical to SEQ ID NO: 446990
  misc_feature: HEFZJCU01AMVJ9.51.70.G04.1.454.heavy.3.raw

SEQ ID NO: 447081 - DNA, 316 bp, Homo sapiens; identical to SEQ ID NO: 444479
  misc_feature: HEFZJCU01BQ9X5.47.84.H07.1.454.heavy.3.raw

SEQ ID NO: 447082 - DNA, 391 bp, Homo sapiens; identical to SEQ ID NO: 444514
  misc_feature: HEFZJCU01B3KR4.12.24.C02.1.454.heavy.3.raw

SEQ ID NO: 447083 - DNA, 500 bp, Homo sapiens
  misc_feature: HEFZJCU01DGVEA.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaagggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccctggcgccctgctccaggagcacctccgagagcacagcggccctgggctgcctggtcaaggactacttcctacgtcgtat

SEQ ID NO: 447084 - DNA, 390 bp, Homo sapiens; identical to SEQ ID NO: 444541
  misc_feature: HEFZJCU01A3SCO.16.24.C02.1.454.heavy.3.raw

SEQ ID NO: 447085 - DNA, 483 bp, Homo sapiens; identical to SEQ ID NO: 444924
  misc_feature: HEFZJCU01DPI1Z.10.35.D02.1.454.heavy.3.raw

SEQ ID NO: 447086 - DNA, 418 bp, Homo sapiens; identical to SEQ ID NO: 445910
  misc_feature: HEFZJCU01C804B.11.62.F07.1.454.heavy.3.raw

SEQ ID NO: 447087 - DNA, 342 bp, Homo sapiens
  misc_feature: HEFZJCU01ELTJI.14.74.G08.1.454.heavy.3.raw
cgtctagtaccacgaccggtgctcgatttagtagctctatcagggagaactgcttcttggacgcgtccaagaagcagttctccctgaagctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 447088 - DNA, 497 bp, Homo sapiens
  misc_feature: HEFZJCU01DBGGE.53.81.H04.1.454.heavy.3.raw
cgcgtatacacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccta

SEQ ID NO: 447089 - DNA, 504 bp, Homo sapiens
  misc_feature: HEFZJCU01CIQIL.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 447090 - DNA, 379 bp, Homo sapiens; identical to SEQ ID NO: 444450
  misc_feature: HEFZJCU01CWL66.47.77.G11.1.454.heavy.3.raw

SEQ ID NO: 447091 - DNA, 514 bp, Homo sapiens
  misc_feature: HEFZJCU01D60U1.14.41.D08.1.454.heavy.3.raw
  modified_base (449)..(449): a, c, t, g, unknown or other
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccgggaaccgtggtcaccgtctcttcngcctcaccaaggcccatcggtcttcccctggcaccctcctccagagcacctctcggggcacagcc

SEQ ID NO: 447092 - DNA, 400 bp, Homo sapiens; identical to SEQ ID NO: 444452
  misc_feature: HEFZJCU01CNQCR.47.24.C02.1.454.heavy.3.raw

SEQ ID NO: 447093 - DNA, 519 bp, Homo sapiens
  misc_feature: HEFZJCU01AM7ZE.12.40.D07.1.454.heavy.3.raw
  modified_base (484)..(484): a, c, t, g, unknown or other
atacgacgtacacgaccggtgctcgatttagtgatagagcgtaacaacagagggctcaccatggagtttgggctgagcgtggtttcgtcgttagctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaaggggccctggtcatcgtctccccngcctccaccaagggcccatcggtcttcccctggcg

SEQ ID NO: 447094 - DNA, 409 bp, Homo sapiens; identical to SEQ ID NO: 444519
  misc_feature: HEFZJCU01EBFB6.3.41.D08.1.454.heavy.3.raw

SEQ ID NO: 447095 - DNA, 515 bp, Homo sapiens
  misc_feature: HEFZJCU01CP22C.17.33.C11.1.454.heavy.3.raw
  modified_base (493)..(493): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactatggggccagggactctggtcaccgtctccanagcctccaccaagggcccatcc

SEQ ID NO: 447096 - DNA, 381 bp, Homo sapiens
  misc_feature: HEFZJCU01AIIN6.49.45.E01.1.454.heavy.3.raw
agtcgagagacacgaccggtgctcgatttagtgagtcagtaagggaaagggggctctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggcgccctgctccaggagcacctccgagagcacagcggccctgggctgcctggtcaaggactacttcctctctcgact

SEQ ID NO: 447097 - DNA, 526 bp, Homo sapiens
  misc_feature: HEFZJCU01DMG2N.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagttggccttgataactggggccaggggatcctggtcaccgtctcctcagcctccaccaac

SEQ ID NO: 447098 - DNA, 518 bp, Homo sapiens
  misc_feature: HEFZJCU01CD3DQ.49.27.C05.1.454.heavy.3.raw
agtcgagagacacgaccggtgctcgatttagacgcgatcgaagggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctctctcgact

SEQ ID NO: 447099 - DNA, 506 bp, Homo sapiens; identical to SEQ ID NO: 444696
  misc_feature: HEFZJCU01A3GXP.16.34.D01.1.454.heavy.3.raw

SEQ ID NO: 447100 - DNA, 381 bp, Homo sapiens; identical to SEQ ID NO: 444427
  misc_feature: HEFZJCU01BF9HH.9.53.E09.1.454.heavy.3.raw

SEQ ID NO: 447101 - DNA, 491 bp, Homo sapiens; identical to SEQ ID NO: 445333
  misc_feature: HEFZJCU01EOE37.19.53.E09.1.454.heavy.3.raw

SEQ ID NO: 447102 - DNA, 536 bp, Homo sapiens
  misc_feature: HEFZJCU01CN223.52.9.A09.1.454.heavy.3.raw
cgcagtacgacacgaccggtgctcgatttagcgagacgcgcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgccctggcgctatggacgtctggggccaagggaccacggtcaccgtctcctcagcctccaccaagggcccatcggtcttcccctgg

SEQ ID NO: 447103 - DNA, 379 bp, Homo sapiens; identical to SEQ ID NO: 444450
  misc_feature: HEFZJCU01AIZKW.47.77.G11.1.454.heavy.3.raw

SEQ ID NO: 447104 - DNA, 535 bp, Homo sapiens
  misc_feature: HEFZJCU01DYYTY.52.73.G07.1.454.heavy.3.raw
cgcagtacgacacgaccggtgctcgatttagctctacgctcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctggggccaagggaccacggtcaccgtctcctcagcctccaccaagggcccatcggtcttcccct

SEQ ID NO: 447105 - DNA, 511 bp, Homo sapiens
  misc_feature: HEFZJCU01CGFRE.49.81.H04.1.454.heavy.3.raw
agtcgagagacacgaccggtgctcgatttagtagtgtagattcgcgggctgggagaggaacccagcactagaagtcggcggtgtttccattcggtgatcaacactgaacacagaggactcaccatggagtttgggctgagcgtggtttcgtcgttaggctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttatactgtgcgaacttaatcacggaggacaaggggtcacccccgtccactc

SEQ ID NO: 447106 - DNA, 518 bp, Homo sapiens; identical to SEQ ID NO: 445220
  misc_feature: HEFZJCU01DY8XE.9.70.G04.1.454.heavy.3.raw

SEQ ID NO: 447107 - DNA, 543 bp, Homo sapiens
  misc_feature: HEFZJCU01E2M1V.13.26.C04.1.454.heavy.3.raw
tcacgtactacacgaccggtgctcgatttagtctagcgactttgggtttgggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggttcggcggactcctcttgtagatctggggccgacgggggacgaataggtcgtaccgtccgtcttctacg

SEQ ID NO: 447108 - DNA, 521 bp, Homo sapiens
  misc_feature: HEFZJCU01CLHJT.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgctgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcggccctgggctgcctggtcaaggactac

SEQ ID NO: 447109 - DNA, 526 bp, Homo sapiens
  misc_feature: HEFZJCU01CUMKU.49.53.E09.1.454.heavy.3.raw
agtcgagagacacgaccggtgctcgatttagagagagtgtgttgggtttgggggatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccggctttccccaggcctggcggtaggtttgaagtgaggtctgtgtcactgtggtcttactatgatagtagtggttatattagcagccactcagcacattcggctactggggccagggaaccctggtcaccgtctcctcagcctccaccaagggcccatcggtcttcccctggcaccctcctccaagagcacctctgggggcacagcggccctgggctgcctggtcaaggactacttcctctctcgact

SEQ ID NO: 447110 - DNA, 489 bp, Homo sapiens; identical to SEQ ID NO: 444791
  misc_feature: HEFZJCU01AUECC.47.85.H08.1.454.heavy.3.raw

SEQ ID NO: 447111 - DNA, 521 bp, Homo sapiens
  misc_feature: HEFZJCU01EFS45.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccaggggaagcttggtcaccgtctcctcagcct

SEQ ID NO: 447112 - DNA, 514 bp, Homo sapiens
  misc_feature: HEFZJCU01EF5O6.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggctaattttggactcgtcattctccctttgacttctggggccagggaaccctagtcaccgtcc

SEQ ID NO: 447113 - DNA, 427 bp, Homo sapiens; identical to SEQ ID NO: 444708
  misc_feature: HEFZJCU01C4XVO.9.34.D01.1.454.heavy.3.raw

SEQ ID NO: 447114 - DNA, 519 bp, Homo sapiens
  misc_feature: HEFZJCU01DRKMV.49.37.D04.1.454.heavy.3.raw
agtcgagagacacgaccggtgctcgatttagtagcatactgttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggccaccctcctccaagagcacctctgggggcacagcggccctgggctgcctggtcaaggactacttcctctctcgact

SEQ ID NO: 447115 - DNA, 483 bp, Homo sapiens; identical to SEQ ID NO: 444924
  misc_feature: HEFZJCU01E0VZB.10.35.D02.1.454.heavy.3.raw

SEQ ID NO: 447116 - DNA, 524 bp, Homo sapiens; identical to SEQ ID NO: 445902
  misc_feature: HEFZJCU01CQ211.9.78.H01.1.454.heavy.3.raw

SEQ ID NO: 447117 - DNA, 520 bp, Homo sapiens
  misc_feature: HEFZJCU01DHQFF.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccgggaaccctggtcaccgtctcccaccctccaccaagggcccatcggtcttcccctggcacctcctccaagagcacctctgggggcacagcggccctgggctgcctggtcaaggactacttcccatactcgta

SEQ ID NO: 447118 - DNA, 523 bp, Homo sapiens
  misc_feature: HEFZJCU01DIJ12.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtcttcccctggcaccctcctccaagagcacctctgggggcacagcggccctgggctgcct

SEQ ID NO: 447119 - DNA, 384 bp, Homo sapiens; identical to SEQ ID NO: 444492
  misc_feature: HEFZJCU01AFHQS.18.60.F05.1.454.heavy.3.raw

SEQ ID NO: 447120 - DNA, 504 bp, Homo sapiens
  misc_feature: HEFZJCU01CM0E7.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggcctgggctgcctggtcaaggactacttcccactacta

SEQ ID NO: 447121 - DNA, 500 bp, Homo sapiens; identical to SEQ ID NO: 444529
  misc_feature: HEFZJCU01CBB51.12.38.D05.1.454.heavy.3.raw

SEQ ID NO: 447122 - DNA, 525 bp, Homo sapiens
  misc_feature: HEFZJCU01DYSL1.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcggcctgggctgcctggtcaaggactacttccg

SEQ ID NO: 447123 - DNA, 501 bp, Homo sapiens
  misc_feature: HEFZJCU01CTSN1.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggggac

SEQ ID NO: 447124 - DNA, 505 bp, Homo sapiens
  misc_feature: HEFZJCU01BPU9M.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacacatgacaccg

SEQ ID NO: 447125 - DNA, 396 bp, Homo sapiens; identical to SEQ ID NO: 444469
  misc_feature: HEFZJCU01B6DEN.47.46.E02.1.454.heavy.3.raw

SEQ ID NO: 447126 - DNA, 501 bp, Homo sapiens
  misc_feature: HEFZJCU01B74QP.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 447127 - DNA, 491 bp, Homo sapiens
  misc_feature: HEFZJCU01EDJD6.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaaccctggtcaccgtctcctc

SEQ ID NO: 447128 - DNA, 479 bp, Homo sapiens
  misc_feature: HEFZJCU01C82HB.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgaggg

SEQ ID NO: 447129 - DNA, 497 bp, Homo sapiens
  misc_feature: HEFZJCU01CNUCA.51.28.C06.1.454.heavy.3.raw
cgatcgtatacacgaccggtgctcgatttagagctcacgtattgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 447130 - DNA, 519 bp, Homo sapiens
  misc_feature: HEFZJCU01EWCGS.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaaggcccatccgtcttcccctggcgccctgctccaggagcacctccgagagcacagcggccctgggctgcctggtcaaggactacttcctacg

SEQ ID NO: 447131 - DNA, 518 bp, Homo sapiens; identical to SEQ ID NO: 446943
  misc_feature: HEFZJCU01D0ERX.7.78.H01.1.454.heavy.3.raw

SEQ ID NO: 447132 - DNA, 373 bp, Homo sapiens; identical to SEQ ID NO: 445969
  misc_feature: HEFZJCU01CDUH4.49.58.F03.1.454.heavy.3.raw

SEQ ID NO: 447133 - DNA, 522 bp, Homo sapiens
  misc_feature: HEFZJCU01DNTY7.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctagttccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 447134 - DNA, 496 bp, Homo sapiens
  misc_feature: HEFZJCU01C3FP7.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggccctggctgcctggtcaaggactacttcctacgtcgtat

SEQ ID NO: 447135 - DNA, 491 bp, Homo sapiens; identical to SEQ ID NO: 444749
  misc_feature: HEFZJCU01CJW5V.11.13.B02.1.454.heavy.3.raw

SEQ ID NO: 447136 - DNA, 520 bp, Homo sapiens
  misc_feature: HEFZJCU01E2IE4.22.86.H09.1.454.heavy.3.raw
acatacgcgtcacgaccggtgctcgatttagtgctatagacttgggtttgggctgagcgtggtttcgtcgtaggctctttaagaggtgtccagtgtcaggtgcagctggtggagtctggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaaggactttgtatctctggggccgaacgggacgactggtctaccgtctctttcagcctccaccaacgggcccgactcggtcgtttcccctccggtcggccctcgctccacgg

SEQ ID NO: 447137 - DNA, 519 bp, Homo sapiens; identical to SEQ ID NO: 444867
  misc_feature: HEFZJCU01EXAV6.9.34.D01.1.454.heavy.3.raw

SEQ ID NO: 447138 - DNA, 496 bp, Homo sapiens
  misc_feature: HEFZJCU01B90K8.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacacgtgct

SEQ ID NO: 447139 - DNA, 413 bp, Homo sapiens; identical to SEQ ID NO: 444933
  misc_feature: HEFZJCU01BDZ0L.51.60.F05.1.454.heavy.3.raw

SEQ ID NO: 447140 - DNA, 466 bp, Homo sapiens
  misc_feature: HEFZJCU01DVMDV.9.53.E09.1.454.heavy.3.raw
  modified_base (262)..(262): a, c, t, g, unknown or other
tgatacgtctcacgaccggtgctcgatttagagagagtgtgggtttggggagatctggttcttggacgtgtctactgacatggtgactcgactcttgaggaagggactggagtgggttgggcggtatttttagtcagtggggacaccaactacagcccctccctcaagagtcgagtcaccatgtcagtagacacgtccaagaaccagatctccctgaagctgacctctgtgaccgccgcggacacggccgtgattttttacngtgcgagagaggccgttattttaggaccagctgttaaaactcctactacggtctggacgtctggggccaggggaccaaggtcaccgtctcctcagcctccaccaagggcccatcggtcttccccctggcgccctgctccaggagcacctccgagagcacagcggccctgggctgcctggtcaaggactacttccagacgtatca

SEQ ID NO: 447141 - DNA, 505 bp, Homo sapiens
  misc_feature: HEFZJCU01DGU7D.3.82.H05.1.454.heavy.3.raw
  modified_base (500)..(500): a, c, t, g, unknown or other
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggggaagggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcgggacgtcctaccnccgtt

SEQ ID NO: 447142 - DNA, 427 bp, Homo sapiens; identical to SEQ ID NO: 444708
  misc_feature: HEFZJCU01BZ3RR.9.34.D01.1.454.heavy.3.raw

SEQ ID NO: 447143 - DNA, 390 bp, Homo sapiens
  misc_feature: HEFZJCU01AXQU3.48.70.G04.1.454.heavy.3.raw
agtatacatacacgaccggtgctcgatttagtgtagtgtgaagggaaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 447144 - DNA, 514 bp, Homo sapiens
  misc_feature: HEFZJCU01D87UN.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggggaactctggtcaccgtctccgcagcctccaccaagggccc

SEQ ID NO: 447145 - DNA, 507 bp, Homo sapiens
  misc_feature: HEFZJCU01ETF15.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggccgcctgctccaggacg

SEQ ID NO: 447146 - DNA, 409 bp, Homo sapiens
  misc_feature: HEFZJCU01CML3V.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttgga

SEQ ID NO: 447147 - DNA, 511 bp, Homo sapiens; identical to SEQ ID NO: 445840
  misc_feature: HEFZJCU01DNG8J.11.13.B02.1.454.heavy.3.raw

SEQ ID NO: 447148 - DNA, 504 bp, Homo sapiens; identical to SEQ ID NO: 445399
  misc_feature: HEFZJCU01DDP6Y.17.74.G08.1.454.heavy.3.raw

SEQ ID NO: 447149 - DNA, 433 bp, Homo sapiens
  misc_feature: HEFZJCU01C02H6.52.53.E09.1.454.heavy.3.raw
cgcagtacgacacgaccggtgctcgatttagagagagtgtgttgggtttgggggaggcttggcacagcctggccggtctccgagactctcctgtgtagggtctggactcaccttggatgcttttggcacgcactgggtctggcaaactccagggaagggcccagagtgggcctcaaatatcacttggaatagtgaaatcatcgcctgtggggtctgtctgtggggccgactcagcatctccagagacaacgccagtaacgtcatccgtctgcaagtgaatcccagactactgggccaggggaggctggtcaccgtctcttgagcctccaccaagggcccatcggtcttccccctggcaccctcctccaagagcacctctgggggcacagcggccctgggctgcctggtcaaggactacttccctatacgatcg

SEQ ID NO: 447150 - DNA, 483 bp, Homo sapiens; identical to SEQ ID NO: 444924
  misc_feature: HEFZJCU01BWVIS.10.35.D02.1.454.heavy.3.raw

SEQ ID NO: 447151 - DNA, 472 bp, Homo sapiens
  misc_feature: HEFZJCU01CRY9Z.14.70.G04.1.454.heavy.3.raw
cgtctagtaccacgaccggtgctcgatttagtgtagtgtgaagggaaagggtccctaaaactctcctgtacaacctcaggattcgcctttcgcatctatgccatggcctgggtccgccagattccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtactagacg

SEQ ID NO: 447152 - DNA, 537 bp, Homo sapiens; identical to SEQ ID NO: 445697
  misc_feature: HEFZJCU01CSA0P.14.57.F02.1.454.heavy.3.raw

SEQ ID NO: 447153 - DNA, 497 bp, Homo sapiens; identical to SEQ ID NO: 445179
  misc_feature: HEFZJCU01AWLQW.12.55.E11.1.454.heavy.3.raw

SEQ ID NO: 447154 - DNA, 324 bp, Homo sapiens; identical to SEQ ID NO: 444475
  misc_feature: HEFZJCU01B2825.18.17.B06.1.454.heavy.3.raw

SEQ ID NO: 447155 - DNA, 395 bp, Homo sapiens; identical to SEQ ID NO: 444494
  misc_feature: HEFZJCU01EBMW2.47.46.E02.1.454.heavy.3.raw

SEQ ID NO: 447156 - DNA, 490 bp, Homo sapiens
  misc_feature: HEFZJCU01CNVV2.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctggctgcctggtcaaggactacttcccacgagagta

SEQ ID NO: 447157 - DNA, 477 bp, Homo sapiens; identical to SEQ ID NO: 444659
  misc_feature: HEFZJCU01DO5IU.16.10.A10.1.454.heavy.3.raw

SEQ ID NO: 447158 - DNA, 537 bp, Homo sapiens; identical to SEQ ID NO: 445697
  misc_feature: HEFZJCU01AR7EN.14.57.F02.1.454.heavy.3.raw

SEQ ID NO: 447159 - DNA, 405 bp, Homo sapiens; identical to SEQ ID NO: 445302
  misc_feature: HEFZJCU01A2XWX.3.17.B06.1.454.heavy.3.raw

SEQ ID NO: 447160 - DNA, 511 bp, Homo sapiens
  misc_feature: HEFZJCU01DGGCP.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaaggactactccgtactacg

SEQ ID NO: 447161 - DNA, 384 bp, Homo sapiens; identical to SEQ ID NO: 445503
  misc_feature: HEFZJCU01DGLGV.48.49.E05.1.454.heavy.3.raw

SEQ ID NO: 447162 - DNA, 525 bp, Homo sapiens; identical to SEQ ID NO: 445545
  misc_feature: HEFZJCU01B4U6U.12.86.H09.1.454.heavy.3.raw

SEQ ID NO: 447163 - DNA, 416 bp, Homo sapiens
  misc_feature: HEFZJCU01BKTM9.3.45.E01.1.454.heavy.3.raw
agacgcactccacgaccggtgctcgatttagtgagtcagtaagggaaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtgcgagagataaatattacgatttttggagtggttattatatctcaagtagcgactcgagaggctactgggaccagggaatccaggtcaccgtctcctcagcctccaccaagggcccatcggtcttccccctggcaccctcctccaagagcacctctgggggcacagcggccctgggctgcctggtcaaggactacttccgagtgcgtt

SEQ ID NO: 447164 - DNA, 537 bp, Homo sapiens
  misc_feature: HEFZJCU01EJ68T.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtcttcccctggccaccctcctccaagacgcacctctgggggcacagcggccctgggctg

SEQ ID NO: 447165 - DNA, 423 bp, Homo sapiens; identical to SEQ ID NO: 446550
  misc_feature: HEFZJCU01ELP95.11.22.B11.1.454.heavy.3.raw

SEQ ID NO: 447166 - DNA, 483 bp, Homo sapiens; identical to SEQ ID NO: 444639
  misc_feature: HEFZJCU01EXRA5.11.23.C01.1.454.heavy.3.raw

SEQ ID NO: 447167 - DNA, 396 bp, Homo sapiens; identical to SEQ ID NO: 444469
  misc_feature: HEFZJCU01D238C.47.46.E02.1.454.heavy.3.raw

SEQ ID NO: 447168 - DNA, 380 bp, Homo sapiens; identical to SEQ ID NO: 444644
  misc_feature: HEFZJCU01A3QDO.9.53.E09.1.454.heavy.3.raw

SEQ ID NO: 447169 - DNA, 410 bp, Homo sapiens
  misc_feature: HEFZJCU01DLLE8.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctggggcacagcggccctgggctgcctggtcaaggactacttcctcgtagcact

SEQ ID NO: 447170 - DNA, 508 bp, Homo sapiens; identical to SEQ ID NO: 446002
  misc_feature: HEFZJCU01AGMZW.9.78.H01.1.454.heavy.3.raw

SEQ ID NO: 447171 - DNA, 512 bp, Homo sapiens; identical to SEQ ID NO: 445688
  misc_feature: HEFZJCU01DPTPO.3.34.D01.1.454.heavy.3.raw

SEQ ID NO: 447172 - DNA, 488 bp, Homo sapiens; identical to SEQ ID NO: 444617
  misc_feature: HEFZJCU01EAWFG.4.6.A06.1.454.heavy.3.raw

SEQ ID NO: 447173 - DNA, 416 bp, Homo sapiens; identical to SEQ ID NO: 444425
  misc_feature: HEFZJCU01EXQ0W.3.45.E01.1.454.heavy.3.raw

SEQ ID NO: 447174 - DNA, 500 bp, Homo sapiens
  misc_feature: HEFZJCU01BLZMN.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgacccctggggccagggaaccctggtcaccgtctcctc

SEQ ID NO: 447175 - DNA, 532 bp, Homo sapiens; identical to SEQ ID NO: 445228
  misc_feature: HEFZJCU01D937D.7.78.H01.1.454.heavy.3.raw

SEQ ID NO: 447176 - DNA, 356 bp, Homo sapiens
  misc_feature: HEFZJCU01D9EP7.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggccaagggaccacagtcatcgtctcctcagcctccaccaagggcccatcggtcttccccctggcaccctcctccaagagcacctctgggggcacagcggccctgggctgcctggtcaaggactacttcctcgtactgcg

SEQ ID NO: 447177 - DNA, 518 bp, Homo sapiens; identical to SEQ ID NO: 444718
  misc_feature: HEFZJCU01EVSS8.9.34.D01.1.454.heavy.3.raw

SEQ ID NO: 447178 - DNA, 520 bp, Homo sapiens
  misc_feature: HEFZJCU01BZBUJ.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcaccgtctccgcagcctccaccg

SEQ ID NO: 447179 - DNA, 517 bp, Homo sapiens
  misc_feature: HEFZJCU01BMH0C.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctaccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacg

SEQ ID NO: 447180 - DNA, 320 bp, Homo sapiens
  misc_feature: HEFZJCU01BNJ55.52.20.B09.1.454.heavy.3.raw
cgcagtacgacacgaccggtgctcgatttagtgtagtgtgaagggccgattcaccatttccagagacagctccgataacacggtctatctgcgaatgaacagcctgagacctgaggacacggctctttttactgtgcgccaggaagcagtggctggccacatgatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctatacgatcg

SEQ ID NO: 447181 - DNA, 412 bp, Homo sapiens
  misc_feature: HEFZJCU01BVXQI.51.60.F05.1.454.heavy.3.raw
cgatcgtatacacgaccggtgctcgatttagtacgtcatcagggaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 447182 - DNA, 496 bp, Homo sapiens; identical to SEQ ID NO: 444697
  misc_feature: HEFZJCU01DKHYK.16.37.D04.1.454.heavy.3.raw

SEQ ID NO: 447183 - DNA, 481 bp, Homo sapiens
  misc_feature: HEFZJCU01EM6BZ.51.67.G01.1.454.heavy.3.raw
  modified_base (446)..(446): a, c, t, g, unknown or other
cgatcgtatacacgaccggtgctcgatttagagtatacatattgggtttgggggctctgggagaggagcccagcactagaagtcggcggtgcttccattcggtgatcagcactgaacacagaggactcaccatggagtttgggctgagcgtggtttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaagggctggagtgggtggcagttatatcatatgatggaagcaagatatactatgtagactccgtgaagggccgattcatcatctccagagacaactccgagaacacgctgtatctgcaaatgaacaggctganagctgaagacacggctgtatattactgtgcgtaaa

SEQ ID NO: 447184 - DNA, 354 bp, Homo sapiens; identical to SEQ ID NO: 446337
  misc_feature: HEFZJCU01CN6D1.49.39.D06.1.454.heavy.3.raw

SEQ ID NO: 447185 - DNA, 479 bp, Homo sapiens
  misc_feature: HEFZJCU01ETUYD.48.45.E01.1.454.heavy.3.raw
agtatacatacacgaccggtgctcgatttagtgagtcagtaagggaaagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagagtggttatt

SEQ ID NO: 447186 - DNA, 521 bp, Homo sapiens
  misc_feature: HEFZJCU01DSJMN.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggcaccctcctccaagacg

SEQ ID NO: 447187 - DNA, 396 bp, Homo sapiens; identical to SEQ ID NO: 444469
  misc_feature: HEFZJCU01BLFID.47.46.E02.1.454.heavy.3.raw

SEQ ID NO: 447188 - DNA, 379 bp, Homo sapiens; identical to SEQ ID NO: 444450
  misc_feature: HEFZJCU01DW60N.47.77.G11.1.454.heavy.3.raw

SEQ ID NO: 447189 - DNA, 510 bp, Homo sapiens
  misc_feature: HEFZJCU01DBSHY.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggccccatcc

SEQ ID NO: 447190 - DNA, 487 bp, Homo sapiens
  misc_feature: HEFZJCU01BZIC2.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattacta

SEQ ID NO: 447191 - DNA, 413 bp, Homo sapiens; identical to SEQ ID NO: 446455
  misc_feature: HEFZJCU01EFWMH.13.25.C03.1.454.heavy.3.raw

SEQ ID NO: 447192 - DNA, 481 bp, Homo sapiens
  misc_feature: HEFZJCU01CQ25L.22.36.D03.1.454.heavy.3.raw
acatacgcgtcacgaccggtgctcgatttagctgcgtcacgatctctcttgggttttgggggggtcccgtgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccacgcgtatgt

SEQ ID NO: 447193 - DNA, 459 bp, Homo sapiens
  misc_feature: HEFZJCU01BLM2S.13.11.A11.1.454.heavy.3.raw
tcacgtactacacgaccggtgctcgatttagctacgactgcagggcttctggaggcaccttcagcacctatgctatcagctgggtgcgacaggcccctggacaagggcttgagtggatgggagggatcatcccgatctttgggaaaccaaactacgcacagaaattccagggcagaatcacgattaccgcggacgaatccacgaccacagcctacatggagctgagcagcctgagatctgaggacacggccgtgtattactgtgcgagagggtcgggccgatattttgactggttatccccctctgatgcttttgatatctggggccaagggacaatggtcaccgtctcttcagcctccaccaagggcccatcggtcttccccctggcaccctcctccaagagcacctctggggcacagcggccctgggctgcctggtcaggactcttcctagtagtga

SEQ ID NO: 447194 - DNA, 506 bp, Homo sapiens; identical to SEQ ID NO: 444696
  misc_feature: HEFZJCU01EYVQT.16.34.D01.1.454.heavy.3.raw

SEQ ID NO: 447195 - DNA, 489 bp, Homo sapiens; identical to SEQ ID NO: 444591
  misc_feature: HEFZJCU01CQ0QU.18.70.G04.1.454.heavy.3.raw

SEQ ID NO: 447196 - DNA, 339 bp, Homo sapiens; identical to SEQ ID NO: 444436
  misc_feature: HEFZJCU01DOXK7.47.38.D05.1.454.heavy.3.raw

SEQ ID NO: 447197 - DNA, 528 bp, Homo sapiens
  misc_feature: HEFZJCU01DMTRE.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatggaaccccggtcc

SEQ ID NO: 447198 - DNA, 528 bp, Homo sapiens
  misc_feature: HEFZJCU01BULDA.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactatggggccagggaacctggtcaccgtctcctcagcctccaccaggg

SEQ ID NO: 447199 - DNA, 483 bp, Homo sapiens; identical to SEQ ID NO: 444924
  misc_feature: HEFZJCU01B2WIG.10.35.D02.1.454.heavy.3.raw

SEQ ID NO: 447200 - DNA, 514 bp, Homo sapiens
  misc_feature: HEFZJCU01ETOR7.48.34.D01.1.454.heavy.3.raw
agtatacatacacgaccggtgctcgatttagatcgtctgtgttgggtttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggacta

SEQ ID NO: 447201 - DNA, 508 bp, Homo sapiens
  misc_feature: HEFZJCU01CR1LP.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 447202 - DNA, 507 bp, Homo sapiens
  misc_feature: HEFZJCU01ESMXD.4.36.D03.1.454.heavy.3.raw
agcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagcaacaaggaaacccagctcagccccaattccatggtgagtcctctgtgctcagtgctgatcaccaagtggaaaggccttggagtccagggctaaggctcctctctgagacctccaccaagggcccatcggtcttcccctggcgccctgctccaggagcacctccgagagcacagcggccctgggctgcctggtcaaggactacttccta

SEQ ID NO: 447203 - DNA, 356 bp, Homo sapiens; identical to SEQ ID NO: 444460
  misc_feature: HEFZJCU01D48NB.47.38.D05.1.454.heavy.3.raw

SEQ ID NO: 447204 - DNA, 381 bp, Homo sapiens; identical to SEQ ID NO: 445431
  misc_feature: HEFZJCU01BNIEM.3.70.G04.1.454.heavy.3.raw

SEQ ID NO: 447205 - DNA, 491 bp, Homo sapiens; identical to SEQ ID NO: 444749
  misc_feature: HEFZJCU01EI5J5.11.13.B02.1.454.heavy.3.raw

SEQ ID NO: 447206 - DNA, 384 bp, Homo sapiens; identical to SEQ ID NO: 445564
  misc_feature: HEFZJCU01DU454.47.29.C07.1.454.heavy.3.raw

SEQ ID NO: 447207 - DNA, 463 bp, Homo sapiens
  misc_feature: HEFZJCU01CSZKA.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgtcaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggactacttccacgagagta

SEQ ID NO: 447208 - DNA, 523 bp, Homo sapiens
  misc_feature: HEFZJCU01EJILH.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccagggaaccctggtcaccgtctcctcagcctccaccaagggcccatcggtcttccccctggccaccctcctccaagagca

SEQ ID NO: 447209 - DNA, 514 bp, Homo sapiens
  misc_feature: HEFZJCU01AGI58.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcaccc

SEQ ID NO: 447210 - DNA, 464 bp, Homo sapiens; identical to SEQ ID NO: 445533
  misc_feature: HEFZJCU01BO5VK.19.10.A10.1.454.heavy.3.raw

SEQ ID NO: 447211 - DNA, 431 bp, Homo sapiens
  misc_feature: HEFZJCU01BVQCB.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctgggccaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 447212 - DNA, 529 bp, Homo sapiens
  misc_feature: HEFZJCU01EK0CP.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctc

SEQ ID NO: 447213 - DNA, 400 bp, Homo sapiens; identical to SEQ ID NO: 444452
  misc_feature: HEFZJCU01DD21V.47.24.C02.1.454.heavy.3.raw

SEQ ID NO: 447214 - DNA, 522 bp, Homo sapiens
  misc_feature: HEFZJCU01EQRR1.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaacgggcccatcggtcttcccctcggcaccctcctccaacgagcacctctgggggcac

SEQ ID NO: 447215 - DNA, 398 bp, Homo sapiens; identical to SEQ ID NO: 444798
  misc_feature: HEFZJCU01D2N7S.4.60.F05.1.454.heavy.3.raw

SEQ ID NO: 447216 - DNA, 470 bp, Homo sapiens; identical to SEQ ID NO: 444866
  misc_feature: HEFZJCU01A0J28.4.36.D03.1.454.heavy.3.raw

SEQ ID NO: 447217 - DNA, 391 bp, Homo sapiens; identical to SEQ ID NO: 445561
  misc_feature: HEFZJCU01C2UFO.13.77.G11.1.454.heavy.3.raw

SEQ ID NO: 447218 - DNA, 504 bp, Homo sapiens; identical to SEQ ID NO: 445222
  misc_feature: HEFZJCU01DDERZ.9.33.C11.1.454.heavy.3.raw

SEQ ID NO: 447219 - DNA, 504 bp, Homo sapiens
  misc_feature: HEFZJCU01B2KSX.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagcgtggagtttccttagctgctattttaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgcggggacactgccgtgtattactgtgccagcagcagcactggccactatatttctttg

SEQ ID NO: 447220 - DNA, 499 bp, Homo sapiens
  misc_feature: HEFZJCU01BAGPK.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 447221 - DNA, 470 bp, Homo sapiens; identical to SEQ ID NO: 444866
  misc_feature: HEFZJCU01C15Q4.4.36.D03.1.454.heavy.3.raw

SEQ ID NO: 447222 - DNA, 500 bp, Homo sapiens
  misc_feature: HEFZJCU01BIZMB.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccagagcacctctggggc

SEQ ID NO: 447223 - DNA, 513 bp, Homo sapiens; identical to SEQ ID NO: 446699
  misc_feature: HEFZJCU01CGGAJ.12.25.C03.1.454.heavy.3.raw

SEQ ID NO: 447224 - DNA, 520 bp, Homo sapiens
  misc_feature: HEFZJCU01DHK0W.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaatacgcacagaggttccagggcagagtcaccattaccgcggacgaggccacgaagacagtctacatggaattgagcagcctgagatttgacgacacggccatgtattactgtgcgagggaggccagctgctgggagcgtctacatatttcgacccctggggccagggaacccagggtcacccgtctcctcagcctccaccaagggcccatccgtcttcccctggcgccctgctccaggagcacctccgagagcacagcggccctgggctgcctggtcaaggactactcctacg

SEQ ID NO: 447225 - DNA, 542 bp, Homo sapiens
  misc_feature: HEFZJCU01CSEC2.12.85.H08.1.454.heavy.3.raw
  modified_base (150)..(150): a, c, t, g, unknown or other
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcggtgngtttctaggtggcttttaaagtagccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttatactgtgcgaaggatcgccctataatggtggttggagtcggggagtttggttcctggggccaggggaaccctggtcaccg

SEQ ID NO: 447226 - DNA, 510 bp, Homo sapiens
  misc_feature: HEFZJCU01E05QL.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 447227 - DNA, 488 bp, Homo sapiens; identical to SEQ ID NO: 444651
  misc_feature: HEFZJCU01BTMVY.16.67.G01.1.454.heavy.3.raw

SEQ ID NO: 447228 - DNA, 464 bp, Homo sapiens; identical to SEQ ID NO: 445062
  misc_feature: HEFZJCU01DZE6G.19.10.A10.1.454.heavy.3.raw

SEQ ID NO: 447229 - DNA, 395 bp, Homo sapiens
  misc_feature: HEFZJCU01CKNBB.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 447230 - DNA, 379 bp, Homo sapiens; identical to SEQ ID NO: 444773
  misc_feature: HEFZJCU01DMGVK.3.59.F04.1.454.heavy.3.raw

SEQ ID NO: 447231 - DNA, 469 bp, Homo sapiens
  misc_feature: HEFZJCU01CSQGQ.49.27.C05.1.454.heavy.3.raw
agtcgagagacacgaccggtgctcgatttagacgcgatcgaaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttccaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 447232 - DNA, 381 bp, Homo sapiens
  misc_feature: HEFZJCU01AIDWX.40.13.B02.1.454.heavy.3.raw
tctagcgactcacgaccggtgctcgatttagtctagcgactttggagtggattgggaggtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggccccatcggtcttccccctggcaccctcctccaagagcacctctgggggcacagcggccctgggctgcctggtcaaggactacttccagtcgctaga

SEQ ID NO: 447233 - DNA, 515 bp, Homo sapiens
  misc_feature: HEFZJCU01EQ7XY.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccc

SEQ ID NO: 447234 - DNA, 516 bp, Homo sapiens
  misc_feature: HEFZJCU01EP296.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaaccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctgtggccaggggaccg

SEQ ID NO: 447235 - DNA, 511 bp, Homo sapiens
  misc_feature: HEFZJCU01DRRYK.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggaccg

SEQ ID NO: 447236 - DNA, 487 bp, Homo sapiens; identical to SEQ ID NO: 445077
  misc_feature: HEFZJCU01D0DZ5.47.85.H08.1.454.heavy.3.raw

SEQ ID NO: 447237 - DNA, 505 bp, Homo sapiens; identical to SEQ ID NO: 444759
  misc_feature: HEFZJCU01EDWH7.10.38.D05.1.454.heavy.3.raw

SEQ ID NO: 447238 - DNA, 526 bp, Homo sapiens
  misc_feature: HEFZJCU01EBR7S.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccgggaacctggtcaccgtctccccacctccaccg

SEQ ID NO: 447239 - DNA, 490 bp, Homo sapiens
  misc_feature: HEFZJCU01CF3YR.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttcgtatctctcg

SEQ ID NO: 447240 - DNA, 511 bp, Homo sapiens
  misc_feature: HEFZJCU01EJUV2.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 447241 - DNA, 427 bp, Homo sapiens
  misc_feature: HEFZJCU01A8HER.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcgccctgctccaggagcacctccgagagcacagcggccctgggctgcctggtcaaggactacttccagacgtatca

SEQ ID NO: 447242 - DNA, 478 bp, Homo sapiens
  misc_feature: HEFZJCU01D134Z.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 447243 - DNA, 397 bp, Homo sapiens
  misc_feature: HEFZJCU01AUR5V.47.46.E02.1.454.heavy.3.raw
agctcacgtacacgaccggtgctcgatttagactcatctacagggaaaggggctggagtgggtctcaagtattgatgagaatggtggaagcactattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 447244 - DNA, 513 bp, Homo sapiens
  misc_feature: HEFZJCU01CHNI3.11.13.B02.1.454.heavy.3.raw
  modified_base (256)..(256): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaagggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctcagagcacctccgagagcacagcggccctcggcgtcg

SEQ ID NO: 447245 - DNA, 391 bp, Homo sapiens
  misc_feature: HEFZJCU01A2HWM.51.46.E02.1.454.heavy.3.raw
cgatcgtatacacgaccggtgctcgatttagactcatctacagggaaaggggctggagtgggtggcagttatatcatatgatggaaagaataaatactatggagactccgtgaagggccgattcaccatctctagagactaatctcaaggagacagtgcatctgcaaatgaacagcctgagaggtgacgacacggctgtgtattactgtcacctcgagagcagcaattggagagaggtttttgatatctggggccaagggactatggtcaccgtctcttcagcctccaccaagggcccatcggtcttccccctggcaccctcctccaagagcacctctgggggcacagcggccctgggctgcctggtcaaggactacttcctcgtagcact

SEQ ID NO: 447246 - DNA, 483 bp, Homo sapiens; identical to SEQ ID NO: 444639
  misc_feature: HEFZJCU01DANZP.11.23.C01.1.454.heavy.3.raw

SEQ ID NO: 447247 - DNA, 379 bp, Homo sapiens; identical to SEQ ID NO: 444450
  misc_feature: HEFZJCU01DRUKK.47.77.G11.1.454.heavy.3.raw

SEQ ID NO: 447248 - DNA, 383 bp, Homo sapiens
  misc_feature: HEFZJCU01EU2OF.49.29.C07.1.454.heavy.3.raw
agtcgagagacacgaccggtgctcgatttagagtgctacgaagggaaagggggctctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggccgccctgctccaggagcacctccgagagcacagcggccctgggctgcctggtcaaggactaccttcctctctcgact

SEQ ID NO: 447249 - DNA, 396 bp, Homo sapiens; identical to SEQ ID NO: 444433
  misc_feature: HEFZJCU01BEWEL.47.59.F04.1.454.heavy.3.raw

SEQ ID NO: 447250 - DNA, 379 bp, Homo sapiens; identical to SEQ ID NO: 444450
  misc_feature: HEFZJCU01BCF8G.47.77.G11.1.454.heavy.3.raw

SEQ ID NO: 447251 - DNA, 477 bp, Homo sapiens; identical to SEQ ID NO: 444659
  misc_feature: HEFZJCU01CO4F5.16.10.A10.1.454.heavy.3.raw

SEQ ID NO: 447252 - DNA, 508 bp, Homo sapiens; identical to SEQ ID NO: 446002
  misc_feature: HEFZJCU01CE4OB.9.78.H01.1.454.heavy.3.raw

SEQ ID NO: 447253 - DNA, 411 bp, Homo sapiens
  misc_feature: HEFZJCU01AN5QX.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttgga

SEQ ID NO: 447254 - DNA, 500 bp, Homo sapiens; identical to SEQ ID NO: 445028
  misc_feature: HEFZJCU01CRRS2.13.12.B01.1.454.heavy.3.raw

SEQ ID NO: 447255 - DNA, 526 bp, Homo sapiens
  misc_feature: HEFZJCU01D9DYJ.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgagctgagctctgtgacagccgcggacacgggcgtttatactgtgcgagagggacggactacggtgactacgtgggggttccgaccccgtggggccagggaaccctggtcaccgtctctcagcctccaccg

SEQ ID NO: 447256 - DNA, 407 bp, Homo sapiens
  misc_feature: HEFZJCU01CGU5P.13.76.G10.1.454.heavy.3.raw
tcacgtactacacgaccggtgctcgatttagtcactcatacagggtgtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 447257 - DNA, 438 bp, Homo sapiens; identical to SEQ ID NO: 444944
  misc_feature: HEFZJCU01CHOXV.51.5.A05.1.454.heavy.3.raw

SEQ ID NO: 447258 - DNA, 520 bp, Homo sapiens; identical to SEQ ID NO: 446100
  misc_feature: HEFZJCU01DFA18.40.81.H04.1.454.heavy.3.raw

SEQ ID NO: 447259 - DNA, 482 bp, Homo sapiens
  misc_feature: HEFZJCU01D5HNO.7.10.A10.1.454.heavy.3.raw
cgtgtctctacacgaccggtgctcgatttagcgtcgatctcaggggtccctggagactctcctgtgacgcctctggcttcccctttagtgactactacatgagctggatccgccagggtccagggaaggggctggagtggattgcatatattagtaatagtggtagtagtagtagaccacgcagactctgtgaagggccgattcaccatcgtccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctggggcacagcggcctgggctgcctggtcaaggactacttcctagagacacg

SEQ ID NO: 447260 - DNA, 522 bp, Homo sapiens; identical to SEQ ID NO: 445345
  misc_feature: HEFZJCU01BEOIX.19.86.H09.1.454.heavy.3.raw

SEQ ID NO: 447261 - DNA, 396 bp, Homo sapiens; identical to SEQ ID NO: 444426
  misc_feature: HEFZJCU01COXXI.18.31.C09.1.454.heavy.3.raw

SEQ ID NO: 447262 - DNA, 483 bp, Homo sapiens
  misc_feature: HEFZJCU01BX81Q.11.23.C01.1.454.heavy.3.raw
cgagagataccacgaccggtgctcgatttagtacacgtgattagggattgggggcagggtgtacacctgtggttctcggggctgccctttggctttggagatggttttctcgagtgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctgggctgcctggtcaaggactacttccgtatctctcg

SEQ ID NO: 447263 - DNA, 378 bp, Homo sapiens
  misc_feature: HEFZJCU01D9OPG.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctccgagagcacagcggccctgggctgcctggtcaaggactacttcctacgtgagct

SEQ ID NO: 447264 - DNA, 509 bp, Homo sapiens; identical to SEQ ID NO: 444586
  misc_feature: HEFZJCU01DYJKS.12.78.H01.1.454.heavy.3.raw

SEQ ID NO: 447265 - DNA, 496 bp, Homo sapiens; identical to SEQ ID NO: 444697
  misc_feature: HEFZJCU01A0TGJ.16.37.D04.1.454.heavy.3.raw

SEQ ID NO: 447266 - DNA, 396 bp, Homo sapiens; identical to SEQ ID NO: 444469
  misc_feature: HEFZJCU01CFN9U.47.46.E02.1.454.heavy.3.raw

SEQ ID NO: 447267 - DNA, 508 bp, Homo sapiens
  misc_feature: HEFZJCU01BP3UK.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcatttac

SEQ ID NO: 447268 - DNA, 519 bp, Homo sapiens
  misc_feature: HEFZJCU01D2KML.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagcgtgcgttttctaggtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaagggctggagtggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggacctcggatggtttgattctggggcaggga

SEQ ID NO: 447269 - DNA, 508 bp, Homo sapiens
  misc_feature: HEFZJCU01B3JX8.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgatactgggccagggaacctggtcgtccg

SEQ ID NO: 447270 - DNA, 516 bp, Homo sapiens
  misc_feature: HEFZJCU01EUEEV.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcacctcctccaagagcacctctgggggcacagcggccctggctgcctggtcaaggactacttcctagagacacg

SEQ ID NO: 447271 - DNA, 517 bp, Homo sapiens
  misc_feature: HEFZJCU01BFBB7.49.33.C11.1.454.heavy.3.raw
agtcgagagacacgaccggtgctcgatttagagtgagctcgttgggtttggggggaggcgtggtccagcctgggaggtccctgagactctcctgttgcagcctctggattcgtctctagtgtctaccctatgcactgggtccgccaggctccaggcaaggggctggaatgggttggcacttatctcatctgatggaaggtctgaatcttagtgccgactccgtgaagggccgattcaccatctccagagacaattccaagaacacactatatcttcaaatgaacactctgagacgtgaggacacggctagtctattactgtgcgactgagatgtcttattacgatgccagtgctttagtaccgttcgacccctggggccagggagccctggtcaccgtctcctcagcttccaccaagggcccatcggtcttcccctggccgccctgctccaggagcacctcgtgggggcaccgagcggccctggactgcctggtcaaggacgtacttcctctctcga

SEQ ID NO: 447272 - DNA, 317 bp, Homo sapiens
  misc_feature: HEFZJCU01EJWL4.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctgggctgcctggtcaaggactacttccgtactagacg

SEQ ID NO: 447273 - DNA, 507 bp, Homo sapiens
  misc_feature: HEFZJCU01C4AU1.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcaacctctggattcacccttagcggttatgccatgagctgggtccgccaggctccagggaaggggctggagtgggtctcaacttttagtggtagtggtggtcacgcctactacgcagactccgtgaagggccggttcaccatctccagagacaattccaagaacacactatatctgcaaatgaacagcctgagagccgaggacacggccgtatattactgtgcgaaaggccagggtatagcagtggctggtaccaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 447274 - DNA, 449 bp, Homo sapiens; identical to SEQ ID NO: 444889
  misc_feature: HEFZJCU01CATR5.9.53.E09.1.454.heavy.3.raw

SEQ ID NO: 447275 - DNA, 505 bp, Homo sapiens; identical to SEQ ID NO: 444759
  misc_feature: HEFZJCU01B53EQ.10.38.D05.1.454.heavy.3.raw

SEQ ID NO: 447276 - DNA, 394 bp, Homo sapiens
  misc_feature: HEFZJCU01AMN6W.49.30.C08.1.454.heavy.3.raw
agtcgagagacacgaccggtgctcgatttagtctgacgtcaaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 447277 - DNA, 491 bp, Homo sapiens; identical to SEQ ID NO: 446104
  misc_feature: HEFZJCU01DEQ49.3.34.D01.1.454.heavy.3.raw

SEQ ID NO: 447278 - DNA, 395 bp, Homo sapiens; identical to SEQ ID NO: 444517
  misc_feature: HEFZJCU01COFYT.16.68.G02.1.454.heavy.3.raw

SEQ ID NO: 447279 - DNA, 400 bp, Homo sapiens; identical to SEQ ID NO: 444452
  misc_feature: HEFZJCU01B9EOV.47.24.C02.1.454.heavy.3.raw

SEQ ID NO: 447280 - DNA, 513 bp, Homo sapiens
  misc_feature: HEFZJCU01EY2HA.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcacc

SEQ ID NO: 447281 - DNA, 516 bp, Homo sapiens
  misc_feature: HEFZJCU01CNJ9E.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggccatcggtcttcccctcggcaccctcctccaagagcacctctgggggcacagcggccctggctgcctggtcaaggactacttcctagagacacg

SEQ ID NO: 447282 - DNA, 386 bp, Homo sapiens; identical to SEQ ID NO: 444972
  misc_feature: HEFZJCU01B7YIP.27.46.E02.1.454.heavy.3.raw

SEQ ID NO: 447283 - DNA, 519 bp, Homo sapiens; identical to SEQ ID NO: 444867
  misc_feature: HEFZJCU01CFJYF.9.34.D01.1.454.heavy.3.raw

SEQ ID NO: 447284 - DNA, 396 bp, Homo sapiens; identical to SEQ ID NO: 444469
  misc_feature: HEFZJCU01BRL06.47.46.E02.1.454.heavy.3.raw

SEQ ID NO: 447285 - DNA, 316 bp, Homo sapiens; identical to SEQ ID NO: 444499
  misc_feature: HEFZJCU01CRC16.13.71.G05.1.454.heavy.3.raw

SEQ ID NO: 447286 - DNA, 488 bp, Homo sapiens
  misc_feature: HEFZJCU01CNMJ2.51.1.A01.1.454.heavy.3.raw
cgatcgtatacacgaccggtgctcgatttagacgtctcatcaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacg

SEQ ID NO: 447287 - DNA, 529 bp, Homo sapiens
  misc_feature: HEFZJCU01EQJWB.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctct

SEQ ID NO: 447288 - DNA, 492 bp, Homo sapiens
  misc_feature: HEFZJCU01EKMQH.11.13.B02.1.454.heavy.3.raw
cgagagataccacgaccggtgctcgatttagtctagcgactttgggtctgggggaggcttggtccagccgtggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 447289 - DNA, 467 bp, Homo sapiens; identical to SEQ ID NO: 445159
  misc_feature: HEFZJCU01CAZIK.48.7.A07.1.454.heavy.3.raw

SEQ ID NO: 447290 - DNA, 519 bp, Homo sapiens
  misc_feature: HEFZJCU01BCA5H.49.67.G01.1.454.heavy.3.raw
agtcgagagacacgaccggtgctcgatttagagtatacatattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaaccccggtcaccgtctcctctgcct

SEQ ID NO: 447291 - DNA, 396 bp, Homo sapiens; identical to SEQ ID NO: 445898
  misc_feature: HEFZJCU01B8OBS.10.42.D09.1.454.heavy.3.raw

SEQ ID NO: 447292 - DNA, 384 bp, Homo sapiens; identical to SEQ ID NO: 444454
  misc_feature: HEFZJCU01EJV19.11.61.F06.1.454.heavy.3.raw

SEQ ID NO: 447293 - DNA, 402 bp, Homo sapiens; identical to SEQ ID NO: 444584
  misc_feature: HEFZJCU01C64G9.10.77.G11.1.454.heavy.3.raw

SEQ ID NO: 447294 - DNA, 441 bp, Homo sapiens
  misc_feature: HEFZJCU01DZKWW.48.20.B09.1.454.heavy.3.raw
agtatacatacacgaccggtgctcgatttagtgtagtgtgaagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttccccctggcgccctgctccaggagcacctctgggggcacagcggccctgggctgcctggtcaaggactacttcctatgtatact

SEQ ID NO: 447295 - DNA, 401 bp, Homo sapiens
  misc_feature: HEFZJCU01CHKY2.13.46.E02.1.454.heavy.3.raw
tcacgtactacacgaccggtgctcgatttagactcatctacagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccctggggcccgggaaccctggtcaccgtctcctcagcctccaccaaggcccatcggtcttcccctggcaccctcctccaagagcacctctggggcacagcggccctgggctgcctggtcaaggactacttcctagtacgtga

SEQ ID NO: 447296 - DNA, 437 bp, Homo sapiens; identical to SEQ ID NO: 444603
  misc_feature: HEFZJCU01D683A.3.21.B10.1.454.heavy.3.raw

SEQ ID NO: 447297 - DNA, 508 bp, Homo sapiens
  misc_feature: HEFZJCU01COF12.18.39.D06.1.454.heavy.3.raw
  modified_base (462)..(462): a, c, t, g, unknown or other
  modified_base (476)..(476): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcgagtcgtgaacgacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcncctctgggggcacngcggcctggctgcctggtcaaggactacttcc

SEQ ID NO: 447298 - DNA, 505 bp, Homo sapiens
  misc_feature: HEFZJCU01A2XSN.2.16.B05.1.454.heavy.3.raw
  modified_base (497)..(497): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtagccatttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtgtattactgtgcgagagaccgctactggggcccgggngccctggt

SEQ ID NO: 447299 - DNA, 396 bp, Homo sapiens; identical to SEQ ID NO: 444469
  misc_feature: HEFZJCU01DTX96.47.46.E02.1.454.heavy.3.raw

SEQ ID NO: 447300 - DNA, 391 bp, Homo sapiens
  misc_feature: HEFZJCU01A9CMB.16.24.C02.1.454.heavy.3.raw
tgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcaccctcctccaagagcacctctgggggcacagcggccctgggctgcctggtcaaggactacttccgagtagtaca

SEQ ID NO: 447301 - DNA, 512 bp, Homo sapiens
  misc_feature: HEFZJCU01C35ZB.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagtttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccagcgggagtccaagtactccttgacgtctgggcc

SEQ ID NO: 447302 - DNA, 516 bp, Homo sapiens
  misc_feature: HEFZJCU01AG8PU.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaagggcccatcc

SEQ ID NO: 447303 - DNA, 515 bp, Homo sapiens
  misc_feature: HEFZJCU01B4GB8.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccagcaaggcccatcggtcttcccctggcaccctcctccaagagcacctctgggggcacagcgccctgggctgcctggtcaaggactacttcctatacg

SEQ ID NO: 447304 - DNA, 324 bp, Homo sapiens; identical to SEQ ID NO: 444475
  misc_feature: HEFZJCU01EV3LZ.18.17.B06.1.454.heavy.3.raw

SEQ ID NO: 447305 - DNA, 512 bp, Homo sapiens
  misc_feature: HEFZJCU01DSKID.48.27.C05.1.454.heavy.3.raw
agtatacatacacgaccggtgctcgatttagacgcgatcgaagggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacaatccacgagcacagcctacatggagctgaggagcctgagatctgacgacacggccgtgtattactgtgcgagagaagggttttacatggttcggggagtctccgacccagcaactggttcgaccccg

SEQ ID NO: 447306 - DNA, 519 bp, Homo sapiens
  misc_feature: HEFZJCU01B148N.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggtaccagctgttaaaaactcctactacggtctggacgtctggggccagggaccaac

SEQ ID NO: 447307 - DNA, 509 bp, Homo sapiens; identical to SEQ ID NO: 445824
  misc_feature: HEFZJCU01DIHI1.9.14.B03.1.454.heavy.3.raw

SEQ ID NO: 447308 - DNA, 397 bp, Homo sapiens
  misc_feature: HEFZJCU01CBYRX.48.41.D08.1.454.heavy.3.raw
agtatacatacacgaccggtgctcgatttagtcacgcgagaaagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 447309 - DNA, 384 bp, Homo sapiens
  misc_feature: HEFZJCU01APSGM.13.61.F06.1.454.heavy.3.raw
tcacgtactacacgaccggtgctcgatttagctacgctctaagggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 447310 - DNA, 495 bp, Homo sapiens
  misc_feature: HEFZJCU01CROOG.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaccctggtcaccgtctcctcagcctccaccg

SEQ ID NO: 447311 - DNA, 506 bp, Homo sapiens; identical to SEQ ID NO: 444696
  misc_feature: HEFZJCU01BOO27.16.34.D01.1.454.heavy.3.raw

SEQ ID NO: 447312 - DNA, 391 bp, Homo sapiens
  misc_feature: HEFZJCU01EHZM6.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaaggaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 447313 - DNA, 313 bp, Homo sapiens; identical to SEQ ID NO: 444518
  misc_feature: HEFZJCU01C7PAW.7.10.A10.1.454.heavy.3.raw

SEQ ID NO: 447314 - DNA, 483 bp, Homo sapiens; identical to SEQ ID NO: 444924
  misc_feature: HEFZJCU01CH7VH.10.35.D02.1.454.heavy.3.raw

SEQ ID NO: 447315 - DNA, 511 bp, Homo sapiens; identical to SEQ ID NO: 446675
  misc_feature: HEFZJCU01BSBZM.4.23.C01.1.454.heavy.3.raw

SEQ ID NO: 447316 - DNA, 482 bp, Homo sapiens
  misc_feature: HEFZJCU01C6U5U.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtggagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 447317 - DNA, 494 bp, Homo sapiens
  misc_feature: HEFZJCU01ANUDE.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtccttcccctggccaccctcctccaagagcacctcgtgggggcacagcggccctgggctgcctggtcaaggactacttccgtatctctcg

SEQ ID NO: 447318 - DNA, 431 bp, Homo sapiens; identical to SEQ ID NO: 445056
  misc_feature: HEFZJCU01ECTYX.11.39.D06.1.454.heavy.3.raw

SEQ ID NO: 447319 - DNA, 494 bp, Homo sapiens
  misc_feature: HEFZJCU01EF0AV.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggcccatcggtcttcccctggcgccctgctccaggagcacctccgagagcacagcggccctgggctgcctggtcaaggactacttccctacagtgct

SEQ ID NO: 447320 - DNA, 396 bp, Homo sapiens; identical to SEQ ID NO: 444469
  misc_feature: HEFZJCU01E1CUN.47.46.E02.1.454.heavy.3.raw

SEQ ID NO: 447321 - DNA, 513 bp, Homo sapiens
  misc_feature: HEFZJCU01ELINF.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgctggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggtaacccg

SEQ ID NO: 447322 - DNA, 418 bp, Homo sapiens; identical to SEQ ID NO: 446028
  misc_feature: HEFZJCU01AGY2J.16.28.C06.1.454.heavy.3.raw

SEQ ID NO: 447323 - DNA, 546 bp, Homo sapiens
  misc_feature: HEFZJCU01C2Z8U.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttggggtttttttttcgttactacggggatgggacgtctgggggccgaggggaccgcggtcaccggtctcctcagcctccaccaagggcccc

SEQ ID NO: 447324 - DNA, 509 bp, Homo sapiens
  misc_feature: HEFZJCU01CE65V.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgccctgctccaggagcacctctgggggcacagcggccctgggctgcctggtcaaggactacttcccata

SEQ ID NO: 447325 - DNA, 396 bp, Homo sapiens
  misc_feature: HEFZJCU01EV40F.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggagccctggtcaccgtctcctcagcctccaccaagggcccatcggtcttccccctggcaccctcctccaagagcacctctgggggcacagcggccctgggctgcctggtcaaggactacttcccatactcgta

SEQ ID NO: 447326 - DNA, 499 bp, Homo sapiens
  misc_feature: HEFZJCU01EK2RL.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccg

SEQ ID NO: 447327 - DNA, 517 bp, Homo sapiens
  misc_feature: HEFZJCU01D2UZD.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 447328 - DNA, 483 bp, Homo sapiens
  misc_feature: HEFZJCU01BG1GZ.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttgaacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 447329 - DNA, 515 bp, Homo sapiens
  misc_feature: HEFZJCU01CNZ5Q.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaagtaccttcagcactgggcgac

SEQ ID NO: 447330 - DNA, 505 bp, Homo sapiens
  misc_feature: HEFZJCU01EE3EK.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttcccctggcgccctgctccaggagcacctccgagagcacagcggccctgggctgcctc

SEQ ID NO: 447331 - DNA, 519 bp, Homo sapiens; identical to SEQ ID NO: 445330
  misc_feature: HEFZJCU01CYWLG.7.78.H01.1.454.heavy.3.raw

SEQ ID NO: 447332 - DNA, 489 bp, Homo sapiens; identical to SEQ ID NO: 444791
  misc_feature: HEFZJCU01BYCHA.47.85.H08.1.454.heavy.3.raw

SEQ ID NO: 447333 - DNA, 489 bp, Homo sapiens; identical to SEQ ID NO: 444591
  misc_feature: HEFZJCU01D7P8T.18.70.G04.1.454.heavy.3.raw

SEQ ID NO: 447334 - DNA, 323 bp, Homo sapiens
  misc_feature: HEFZJCU01AJU4Q.47.38.D05.1.454.heavy.3.raw
agctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctgggggcacagcagccctgggctgcctggtcaaggactacttcctacgtgagct

SEQ ID NO: 447335 - DNA, 504 bp, Homo sapiens
  misc_feature: HEFZJCU01DFBJ5.16.71.G05.1.454.heavy.3.raw
tgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaccca

SEQ ID NO: 447336 - DNA, 387 bp, Homo sapiens
  misc_feature: HEFZJCU01BG8PL.48.53.E09.1.454.heavy.3.raw
agtatacatacacgaccggtgctcgatttagagagagtgtgttgggtttgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctggggccagggatacctggtcaccgtctcctcagcttccaccaagggcccatcggtcttccccctggcgccctgctccaggagcacctctgggggcacagcggccctgggctgcctggtcaaggactacttcctatgtatact

SEQ ID NO: 447337 - DNA, 497 bp, Homo sapiens; identical to SEQ ID NO: 444995
  misc_feature: HEFZJCU01D9K6Q.4.26.C04.1.454.heavy.3.raw

SEQ ID NO: 447338 - DNA, 497 bp, Homo sapiens
  misc_feature: HEFZJCU01EVYAE.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcgccctgggctgcctggtcaaggactaccg

SEQ ID NO: 447339 - DNA, 516 bp, Homo sapiens
  misc_feature: HEFZJCU01BW7WJ.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcggcttggacatctggggccgac

SEQ ID NO: 447340 - DNA, 338 bp, Homo sapiens; identical to SEQ ID NO: 444748
  misc_feature: HEFZJCU01AUY7D.11.26.C04.1.454.heavy.3.raw

SEQ ID NO: 447341 - DNA, 482 bp, Homo sapiens; identical to SEQ ID NO: 445068
  misc_feature: HEFZJCU01CNTAJ.11.23.C01.1.454.heavy.3.raw

SEQ ID NO: 447342 - DNA, 443 bp, Homo sapiens; identical to SEQ ID NO: 446583
  misc_feature: HEFZJCU01DOMEA.10.11.A11.1.454.heavy.3.raw

SEQ ID NO: 447343 - DNA, 392 bp, Homo sapiens; identical to SEQ ID NO: 444626
  misc_feature: HEFZJCU01BBRVR.49.46.E02.1.454.heavy.3.raw

SEQ ID NO: 447344 - DNA, 450 bp, Homo sapiens; identical to SEQ ID NO: 444893
  misc_feature: HEFZJCU01E1HJH.53.57.F02.1.454.heavy.3.raw

SEQ ID NO: 447345 - DNA, 400 bp, Homo sapiens; identical to SEQ ID NO: 444452
  misc_feature: HEFZJCU01D4X14.47.24.C02.1.454.heavy.3.raw

SEQ ID NO: 447346 - DNA, 375 bp, Homo sapiens; identical to SEQ ID NO: 444459
  misc_feature: HEFZJCU01AIN4E.48.59.F04.1.454.heavy.3.raw

SEQ ID NO: 447347 - DNA, 514 bp, Homo sapiens
  misc_feature: HEFZJCU01CGRY1.48.81.H04.1.454.heavy.3.raw
agtatacatacacgaccggtgctcgatttagtagtgtagattcgcggggacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggagtggacggagctcggttttcggagttatcatctactactttgaatcttggggcccc

SEQ ID NO: 447348 - DNA, 322 bp, Homo sapiens
  misc_feature: HEFZJCU01CX8C3.47.38.D05.1.454.heavy.3.raw
agctcacgtacacgaccggtgctcgatttagtatctgatagttgggtttgggtgcccaagccgctggagggcacggtcaccacgctgctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagct

SEQ ID NO: 447349 - DNA, 511 bp, Homo sapiens
  misc_feature: HEFZJCU01CL76L.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtggtttctgtagtatttacaagtgtcagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgcgggtggtacctggtattc

SEQ ID NO: 447350 - DNA, 507 bp, Homo sapiens
  misc_feature: HEFZJCU01C9XSI.53.77.G11.1.454.heavy.3.raw
cgcgtatacacacgaccggtgctcgatttagctagtcactcaagggaaaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcggctggtggagtctggggggggctggtccagcctgggaggtccctgagactctcctgtgcagcgtctggattcagtctcagcatctatggcgtgcattgggtccgccaggctccaggcaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcggagggggggactaggatttggtggctacgga

SEQ ID NO: 447351 - DNA, 371 bp, Homo sapiens; identical to SEQ ID NO: 444435
  misc_feature: HEFZJCU01CHD34.3.42.D09.1.454.heavy.3.raw

SEQ ID NO: 447352 - DNA, 525 bp, Homo sapiens
  misc_feature: HEFZJCU01CK68C.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtctagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccttgacttctgggccatggaacccggtcc

SEQ ID NO: 447353 - DNA, 490 bp, Homo sapiens; identical to SEQ ID NO: 445788
  misc_feature: HEFZJCU01D25XL.11.26.C04.1.454.heavy.3.raw

SEQ ID NO: 447354 - DNA, 487 bp, Homo sapiens; identical to SEQ ID NO: 445219
  misc_feature: HEFZJCU01DAZ2Q.10.85.H08.1.454.heavy.3.raw

SEQ ID NO: 447355 - DNA, 379 bp, Homo sapiens; identical to SEQ ID NO: 444450
  misc_feature: HEFZJCU01EJCO5.47.77.G11.1.454.heavy.3.raw

SEQ ID NO: 447356 - DNA, 506 bp, Homo sapiens; identical to SEQ ID NO: 444696
  misc_feature: HEFZJCU01B41EX.16.34.D01.1.454.heavy.3.raw

SEQ ID NO: 447357 - DNA, 502 bp, Homo sapiens; identical to SEQ ID NO: 445414
  misc_feature: HEFZJCU01B7GVY.17.25.C03.1.454.heavy.3.raw

SEQ ID NO: 447358 - DNA, 422 bp, Homo sapiens; identical to SEQ ID NO: 444681
  misc_feature: HEFZJCU01EZIDR.16.78.H01.1.454.heavy.3.raw

SEQ ID NO: 447359 - DNA, 537 bp, Homo sapiens
  misc_feature: HEFZJCU01EA8BL.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgctggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggccaccctcctccaagagcacctcgtgggggcacac

SEQ ID NO: 447360 - DNA, 483 bp, Homo sapiens; identical to SEQ ID NO: 444924
  misc_feature: HEFZJCU01BM3SG.10.35.D02.1.454.heavy.3.raw

SEQ ID NO: 447361 - DNA, 512 bp, Homo sapiens
  misc_feature: HEFZJCU01B9HT7.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccaggggaaccctggtcgtccg

SEQ ID NO: 447362 - DNA, 403 bp, Homo sapiens; identical to SEQ ID NO: 444540
  misc_feature: HEFZJCU01BB4S2.16.72.G06.1.454.heavy.3.raw

SEQ ID NO: 447363 - DNA, 519 bp, Homo sapiens; identical to SEQ ID NO: 445330
  misc_feature: HEFZJCU01AS6A4.7.78.H01.1.454.heavy.3.raw

SEQ ID NO: 447364 - DNA, 403 bp, Homo sapiens; identical to SEQ ID NO: 445029
  misc_feature: HEFZJCU01AKQ4J.10.77.G11.1.454.heavy.3.raw

SEQ ID NO: 447365 - DNA, 375 bp, Homo sapiens
  misc_feature: HEFZJCU01B0DO1.7.37.D04.1.454.heavy.3.raw
cgtgtctctacacgaccggtgctcgatttagtagcatactgttgggtttgggtggaccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggcgccctgctccaggagcacctccgagagcacagcggccctgggctgcctggtcaaggactacttcctagagacacg

SEQ ID NO: 447366 - DNA, 482 bp, Homo sapiens
  misc_feature: HEFZJCU01B9U1H.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggaccacttcctacgtgagct

SEQ ID NO: 447367 - DNA, 483 bp, Homo sapiens; identical to SEQ ID NO: 444924
  misc_feature: HEFZJCU01CUKXU.10.35.D02.1.454.heavy.3.raw

SEQ ID NO: 447368 - DNA, 391 bp, Homo sapiens
  misc_feature: HEFZJCU01CDQH9.13.77.G11.1.454.heavy.3.raw
tcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaaccctggtcaccgtctcctcaccctccaccaagggcccatcggtcttccccctggcaccctcctccaagagcacctctgggggcacagcggccctgggctgcctggtcaaggactacttccgtactagacg

SEQ ID NO: 447369 - DNA, 384 bp, Homo sapiens; identical to SEQ ID NO: 444454
  misc_feature: HEFZJCU01DQL4C.11.61.F06.1.454.heavy.3.raw

SEQ ID NO: 447370 - DNA, 489 bp, Homo sapiens; identical to SEQ ID NO: 444791
  misc_feature: HEFZJCU01CQNG9.47.85.H08.1.454.heavy.3.raw

SEQ ID NO: 447371 - DNA, 511 bp, Homo sapiens
  misc_feature: HEFZJCU01BZXIQ.19.85.H08.1.454.heavy.3.raw
tactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccaggaaaggggctggagtggattgcctatgtcactagtgagggcgaagtcacgtcctacgcggactctgtgcggggccggtttaccatctccagagacaatgccaagaagacgctctttctgcaattggacggcctgagagtcgaagacacggctatttattactgtgtgagagaggggggcactggctggtcgggtcgatcttttgt

SEQ ID NO: 447372 - DNA, 483 bp, Homo sapiens; identical to SEQ ID NO: 444639
  misc_feature: HEFZJCU01EDY07.11.23.C01.1.454.heavy.3.raw

SEQ ID NO: 447373 - DNA, 516 bp, Homo sapiens
  misc_feature: HEFZJCU01B1Y3B.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgacgcagacacggccgtgtattactgtgcgagactggccgcaacagactacggtggcaactcctatgcttttgatatctggggccaagggacaatggtcaccgtctcttcagcctccaccaagggcccatcggtcttcccctggcaccctcctccaagagcacctctgggggcacagccggcccg

SEQ ID NO: 447374 - DNA, 518 bp, Homo sapiens; identical to SEQ ID NO: 444718
  misc_feature: HEFZJCU01EWMIH.9.34.D01.1.454.heavy.3.raw

SEQ ID NO: 447375 - DNA, 415 bp, Homo sapiens; identical to SEQ ID NO: 444794
  misc_feature: HEFZJCU01C2OGL.14.74.G08.1.454.heavy.3.raw

SEQ ID NO: 447376 - DNA, 500 bp, Homo sapiens; identical to SEQ ID NO: 444529
  misc_feature: HEFZJCU01EFTA5.12.38.D05.1.454.heavy.3.raw

SEQ ID NO: 447377 - DNA, 513 bp, Homo sapiens
  misc_feature: HEFZJCU01DRE37.4.36.D03.1.454.heavy.3.raw
agcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagcaacaaggaaaacccagctcagccccaattccatggtgagtcctctgtgctcagtgctgatcaccaagtggaaaggccttggagtccagggctaaggctcctctctgagacctccaccaagggcccatcggtcttcccctggcgccctgctccaggagcacctcccgagacgcaccagcggccctgggctgcctggtcaaggactacttccctac

SEQ ID NO: 447378 - DNA, 379 bp, Homo sapiens; identical to SEQ ID NO: 444450
  misc_feature: HEFZJCU01BKNEM.47.77.G11.1.454.heavy.3.raw

SEQ ID NO: 447379 - DNA, 530 bp, Homo sapiens
  misc_feature: HEFZJCU01EZTUV.49.46.E02.1.454.heavy.3.raw
agtcgagagacacgaccggtgctcgatttagactcatctacagggaaaggggggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttcccctgg

SEQ ID NO: 447380 - DNA, 491 bp, Homo sapiens; identical to SEQ ID NO: 445333
  misc_feature: HEFZJCU01BC8KH.19.53.E09.1.454.heavy.3.raw

SEQ ID NO: 447381 - DNA, 529 bp, Homo sapiens
  misc_feature: HEFZJCU01BJ4WB.51.73.G07.1.454.heavy.3.raw
cgatcgtatacacgaccggtgctcgatttagctctacgctcagggcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacgggagttacttcctccgcaacggtatggacgtctggggccaagggaccacggtcaccgtctccttagcctccaccaagggcccacg

SEQ ID NO: 447382 - DNA, 499 bp, Homo sapiens
  misc_feature: HEFZJCU01CTV3K.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaagcggtaggcctatc

SEQ ID NO: 447383 - DNA, 508 bp, Homo sapiens; identical to SEQ ID NO: 445230
  misc_feature: HEFZJCU01CEOUV.14.25.C03.1.454.heavy.3.raw

SEQ ID NO: 447384 - DNA, 512 bp, Homo sapiens
  misc_feature: HEFZJCU01EF3KU.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccacgggccc

SEQ ID NO: 447385 - DNA, 396 bp, Homo sapiens; identical to SEQ ID NO: 444469
  misc_feature: HEFZJCU01EAGPB.47.46.E02.1.454.heavy.3.raw

SEQ ID NO: 447386 - DNA, 500 bp, Homo sapiens
  misc_feature: HEFZJCU01EAVYI.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgtttctgtcatcgtacaatttgataggctctatggactggacttctc

SEQ ID NO: 447387 - DNA, 519 bp, Homo sapiens
  misc_feature: HEFZJCU01EDGAC.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcacctcctccaagagcacctctgggggcacagcggcctgggctgcctggtcaa

SEQ ID NO: 447388 - DNA, 519 bp, Homo sapiens
  misc_feature: HEFZJCU01BVER7.53.74.G08.1.454.heavy.3.raw
cgcgtatacacacgaccggtgctcgatttagtagctctatcagggggagagaggagcccagccctgggattttcaggtgttttcatttggtgatcaggactgaacagagagaactcaccatggagtttgggctgagcgtcggcgttttctagtggctattttaaaaggtgtccagtgtgaggtgcagctggtggagtctgggggaggcttggtagagcctggggggtccctgagactctcctgtgcagcctctggattcacctttagcagctacgccatgagctgggtccgccaggctccagggaaggggctggagtgggtctcagcaattactggtggtggtggtagggcatactacgcagactccgtgaggggccggttcaccatctccagtgacaattccaagaacacgctgtatctgcaaatgaacagcctgagagccgaggacacgggccgtttaattactgtgcgaaacacatttttggactccttgccatagacgcctactactttgactcg

SEQ ID NO: 447389 - DNA, 501 bp, Homo sapiens
  misc_feature: HEFZJCU01BL6VM.52.19.B08.1.454.heavy.3.raw
cgcagtacgacacgaccggtgctcgatttagtgagtcagtaagggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctggggccaagggaccacggtcatcgtctcctcagcctccaccaaggcccatcggtcttcccctggcaccctcctccaagagcacctctgggggcacagcggccctggctgcctggtcg

SEQ ID NO: 447390 - DNA, 528 bp, Homo sapiens
  misc_feature: HEFZJCU01DYS1T.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccgccctcg

SEQ ID NO: 447391 - DNA, 406 bp, Homo sapiens; identical to SEQ ID NO: 445177
  misc_feature: HEFZJCU01BI4F4.51.77.G11.1.454.heavy.3.raw

SEQ ID NO: 447392 - DNA, 516 bp, Homo sapiens
  misc_feature: HEFZJCU01D5CWT.52.53.E09.1.454.heavy.3.raw
cgcagtacgacacgaccggtgctcgatttagagagagtgtgttgggtttgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaactctggggccagggaccc

SEQ ID NO: 447393 - DNA, 525 bp, Homo sapiens
  misc_feature: HEFZJCU01EBOF1.10.38.D05.1.454.heavy.3.raw
catagtagtgcacgaccggtgctcgatttagtatctgatagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaacctattattgtgcgcgacatgactacgctcaattcgtggggccagggacgcccgaggtccacccgtcctccccacgccctccaccgaacgggcccagtccggtccttccccgtggccgccctgcctccaggagcacctccgagagccacagccggccctgggctcgccg

SEQ ID NO: 447394 - DNA, 442 bp, Homo sapiens
  misc_feature: HEFZJCU01B91ZE.48.20.B09.1.454.heavy.3.raw
agtatacatacacgaccggtgctcgatttagtgtagtgtgagggttctggatacagctttgccaactactggatcgcctgggtgcgccagatgccccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttccccctggcgccctgctccaggagcacctcgtgggggcacagcggccctgggctgcctggtcaaggactacttcctatgtatact

SEQ ID NO: 447395 - DNA, 379 bp, Homo sapiens; identical to SEQ ID NO: 444450
  misc_feature: HEFZJCU01ARVP3.47.77.G11.1.454.heavy.3.raw

SEQ ID NO: 447396 - DNA, 490 bp, Homo sapiens
  misc_feature: HEFZJCU01EP4SS.47.85.H08.1.454.heavy.3.raw
agctcacgtacacgaccggtgctcgatttagtatcactcagtcggggggaggcgtggtccagcctgggacgtccctgagacgtctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 447397 - DNA, 516 bp, Homo sapiens
  misc_feature: HEFZJCU01CL8O3.10.30.C08.1.454.heavy.3.raw
catagtagtgcacgaccggtgctcgatttagtctgacgtcaaagggaaaggggtgggagaggagccccagccctgagattcccaggtgtttccattcagtgatcaccactgaacacaaaggactcaccatgcatttgggactgccctggattttcctctttgctattttaaaaggtgtcctctgtgaagaactattagtggaatctgggggagccttggtacagcctggcgggtccctgagactctcctgtacagtctctggattcacctctgatgattatgccatgcactgggtccggcaagctccagggaagggcctggagtgggtctctggaatcacttacaatagtgatttccttaaatatgcggactctgtgagggggcgtttcaccatctccagagacaacgccaggaactccctctatctacaatgaacagtctgagacctgaggacacggccttatatttctgtgcaaagatcttgagctggccgtgaccactggggccagggaccct

SEQ ID NO: 447398 - DNA, 502 bp, Homo sapiens
  misc_feature: HEFZJCU01CQDYC.22.86.H09.1.454.heavy.3.raw
acatacgcgtcacgaccggtgctcgatttagtgctatagacttgggtttgggctgagcgtgggttttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaaggcccatcggtcttcccctggcgccctgct

SEQ ID NO: 447399 - DNA, 499 bp, Homo sapiens
  misc_feature: HEFZJCU01D94LM.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggacacttcctacgtcgtat

SEQ ID NO: 447400 - DNA, 506 bp, Homo sapiens; identical to SEQ ID NO: 446520
  misc_feature: HEFZJCU01B6ZEQ.10.38.D05.1.454.heavy.3.raw

SEQ ID NO: 447401 - DNA, 318 bp, Homo sapiens
  misc_feature: HEFZJCU01BW0TW.47.55.E11.1.454.heavy.3.raw
agctcacgtacacgaccggtgctcgatttagcactcgcacgttggttttgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgccctgctccaggagcacctccgagagcacagcggccctgggctgcctggtcaaggactacttcctacgtgagct

SEQ ID NO: 447402 - DNA, 500 bp, Homo sapiens; identical to SEQ ID NO: 445028
  misc_feature: HEFZJCU01CKJXL.13.12.B01.1.454.heavy.3.raw

SEQ ID NO: 447403 - DNA, 366 bp, Homo sapiens; identical to SEQ ID NO: 444505
  misc_feature: HEFZJCU01B3PTZ.11.20.B09.1.454.heavy.3.raw

SEQ ID NO: 447404 - DNA, 524 bp, Homo sapiens; identical to SEQ ID NO: 446153
  misc_feature: HEFZJCU01BQAIA.12.86.H09.1.454.heavy.3.raw

SEQ ID NO: 447405 - DNA, 534 bp, Homo sapiens
  misc_feature: HEFZJCU01D0I01.15.87.H10.1.454.heavy.3.raw
tctacgtagccacgaccggtgctcgatttagcagtactgcgttgggttttccttgttgctattttagaaggtgtccagtgtgaggtgcagttggtggagtctggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccatcggtcttcccctggcaccctcctccaagagcacctctgggggcacagcggccctgggctgcctggt

SEQ ID NO: 447406 - DNA, 500 bp, Homo sapiens
  misc_feature: HEFZJCU01DQFHM.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctggggatctagttatagtgactcgtcgttctgggg

SEQ ID NO: 447407 - DNA, 396 bp, Homo sapiens; identical to SEQ ID NO: 444469
  misc_feature: HEFZJCU01D7AV9.47.46.E02.1.454.heavy.3.raw

SEQ ID NO: 447408 - DNA, 424 bp, Homo sapiens
  misc_feature: HEFZJCU01EU1LX.51.30.C08.1.454.heavy.3.raw
cgatcgtatacacgaccggtgctcgatttagtctgacgtcaaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 447409 - DNA, 504 bp, Homo sapiens
  misc_feature: HEFZJCU01C6BQ3.52.33.C11.1.454.heavy.3.raw
cgcagtacgacacgaccggtgctcgatttagagtgagctcgttgggtttgggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactactccta

SEQ ID NO: 447410 - DNA, 491 bp, Homo sapiens
  misc_feature: HEFZJCU01B7UUF.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgagagcacagcggccctgggctgcctggtcaggactacttccgtatctctcg

SEQ ID NO: 447411 - DNA, 501 bp, Homo sapiens; identical to SEQ ID NO: 445341
  misc_feature: HEFZJCU01DRCZE.48.34.D01.1.454.heavy.3.raw

SEQ ID NO: 447412 - DNA, 464 bp, Homo sapiens; identical to SEQ ID NO: 445062
  misc_feature: HEFZJCU01BWXRL.19.10.A10.1.454.heavy.3.raw

SEQ ID NO: 447413 - DNA, 397 bp, Homo sapiens; identical to SEQ ID NO: 444534
  misc_feature: HEFZJCU01EDWLS.18.1.A01.1.454.heavy.3.raw

SEQ ID NO: 447414 - DNA, 383 bp, Homo sapiens; identical to SEQ ID NO: 444477
  misc_feature: HEFZJCU01EP3HI.47.60.F05.1.454.heavy.3.raw

SEQ ID NO: 447415 - DNA, 373 bp, Homo sapiens; identical to SEQ ID NO: 445918
  misc_feature: HEFZJCU01A5HTP.49.30.C08.1.454.heavy.3.raw

SEQ ID NO: 447416 - DNA, 432 bp, Homo sapiens; identical to SEQ ID NO: 444920
  misc_feature: HEFZJCU01ELWFF.11.39.D06.1.454.heavy.3.raw

SEQ ID NO: 447417 - DNA, 379 bp, Homo sapiens; identical to SEQ ID NO: 444450
  misc_feature: HEFZJCU01CRXB1.47.77.G11.1.454.heavy.3.raw

SEQ ID NO: 447418 - DNA, 423 bp, Homo sapiens; identical to SEQ ID NO: 444772
  misc_feature: HEFZJCU01CPM71.16.78.H01.1.454.heavy.3.raw

SEQ ID NO: 447419 - DNA, 407 bp, Homo sapiens
  misc_feature: HEFZJCU01DVLRB.49.43.D10.1.454.heavy.3.raw
agtcgagagacacgaccggtgctcgatttagactagcagtaaggggctggagtgggtctctgccattagtggaagtggtgatctcagatactacggagactccgtgaagggccggttcaccatctccagagacaactccaagaatacgctctatctacacatgaaaacctaagagccgacgacacggccgtctattactgtgcaaagtgggtcacggactacgatgatactagtggctattactccggtgactactttgactactggggccagggaaccctggtcactgtctcctcagcctccaccaagggcccatcggtcttccccctggcaccctcctccaagagcacctctgggggcacagcggccctgggctgcctggtcaaggactacttcctctctcgact

SEQ ID NO: 447420 - DNA, 557 bp, Homo sapiens
  misc_feature: HEFZJCU01CW08O.18.14.B03.1.454.heavy.3.raw
tacgagtatgcacgaccggtgctcgatttagtgtgagtagtttgggctgagctgggttttccttgttgctatttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcgaaacgggggggtactacgtacgctatggacgtctggggccaagggaccacggtcaccgtctcctcagcctccaccaacgggcccactcggtccttcccctggccaccctcctccaacgagcacctcgtggggcacg

SEQ ID NO: 447421 - DNA, 396 bp, Homo sapiens; identical to SEQ ID NO: 444469
  misc_feature: HEFZJCU01AQC3G.47.46.E02.1.454.heavy.3.raw

SEQ ID NO: 447422 - DNA, 512 bp, Homo sapiens
  misc_feature: HEFZJCU01EJEQE.40.36.D03.1.454.heavy.3.raw
tctagcgactcacgaccggtgctcgatttagctgcgtcacgatctctcttgggggggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctggagtgggttggccgtgttaaaccaaagctgagggtgggacaatagactacgctgcacccgtgacaggcagattcgccatctcaagagatgattcagaaggcacgctgtatctgcaaatgaacagcctagaaagccgaggacacagccgtgtattattgtaccgcagggctcgggttactccgatactgactt

SEQ ID NO: 447423 - DNA, 513 bp, Homo sapiens
  misc_feature: HEFZJCU01A1JS7.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggcgccctgctccagagcacctctggggcacagcggcccg

SEQ ID NO: 447424 - DNA, 423 bp, Homo sapiens; identical to SEQ ID NO: 444772
  misc_feature: HEFZJCU01B2LIP.16.78.H01.1.454.heavy.3.raw

SEQ ID NO: 447425 - DNA, 399 bp, Homo sapiens
  misc_feature: HEFZJCU01EPYCB.53.45.E01.1.454.heavy.3.raw
cgcgtatacacacgaccggtgctcgatttagtgagtcagtaagggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 447426 - DNA, 405 bp, Homo sapiens
  misc_feature: HEFZJCU01AZQ3L.53.77.G11.1.454.heavy.3.raw
cgcgtatacacacgaccggtgctcgatttagctagtcactcaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccatttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 447427 - DNA, 508 bp, Homo sapiens
  misc_feature: HEFZJCU01ASOD2.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcatcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaggactacttcctacgtcgtat

SEQ ID NO: 447428 - DNA, 481 bp, Homo sapiens; identical to SEQ ID NO: 446362
  misc_feature: HEFZJCU01EV8K4.19.67.G01.1.454.heavy.3.raw

SEQ ID NO: 447429 - DNA, 437 bp, Homo sapiens; identical to SEQ ID NO: 444603
  misc_feature: HEFZJCU01D0AUM.3.21.B10.1.454.heavy.3.raw

SEQ ID NO: 447430 - DNA, 501 bp, Homo sapiens
  misc_feature: HEFZJCU01CXTRT.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagcgtggtttctgttagctctttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttggtccgcgggcttctggggccagggaa

SEQ ID NO: 447431 - DNA, 521 bp, Homo sapiens
  misc_feature: HEFZJCU01BW7IQ.12.40.D07.1.454.heavy.3.raw
atacgacgtacacgaccggtgctcgatttagtgatagagcgtaacaacagagggctcaccatggagtttgggctgagcgtggtttcgtcgttaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggccctggtcatcgtctccccagcctccaccaagggcccatcggtcttcccctggcg

SEQ ID NO: 447432 - DNA, 490 bp, Homo sapiens
  misc_feature: HEFZJCU01C4XT4.52.77.G11.1.454.heavy.3.raw
cgcagtacgacacgaccggtgctcgatttagctagtcactcaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaaatgaacagcctgagagctgaggacacggctgtgtattactgtgcgaacttaatcacgga

SEQ ID NO: 447433 - DNA, 487 bp, Homo sapiens; identical to SEQ ID NO: 445077
  misc_feature: HEFZJCU01BGO8K.47.85.H08.1.454.heavy.3.raw

SEQ ID NO: 447434 - DNA, 374 bp, Homo sapiens
  misc_feature: HEFZJCU01DHEHU.13.5.A05.1.454.heavy.3.raw
tcacgtactacacgaccggtgctcgatttagatagatagacagggggaggcattagacattacgcagactccgtgaagggccgattcacagtttccagagacaattccaagaatacggtgtttctgcaaatggacagcctgcggggcgacgacacggctaaatattactgtacgagagaccatttccatgactatggtgtctctcccggattttacaagggcatggacgtctggggccaagggactaccgttaccgtcgccgcagcctccaccaagggcccatcggtcttccccctggcgccctgctccaggagcacctccgagagcacagcggccctgggctgcctggtcaaggactacttcctagtacgtga

SEQ ID NO: 447435 - DNA, 511 bp, Homo sapiens
  misc_feature: HEFZJCU01C9RE6.49.30.C08.1.454.heavy.3.raw
agtcgagagacacgaccggtgctcgatttagtctgacgtcaaagggaaaggggggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggt

SEQ ID NO: 447436 - DNA, 518 bp, Homo sapiens
  misc_feature: HEFZJCU01CMRXB.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggacc

SEQ ID NO: 447437 - DNA, 458 bp, Homo sapiens
  misc_feature: HEFZJCU01EWHFN.13.11.A11.1.454.heavy.3.raw
tcacgtactacacgaccggtgctcgatttagctacgactgcagggcttctggaggcaccttcagcacctatgctatcagctgggtgcgacaggcccctggacaagggcttgagtggatgggagggatcatcccgatctttgggaaaccaaactacgcacagaaattccagggcagaatcacgattaccgcggacgaatccacgaccacagcctacatggagctgagcagcctgagatctgaggacacggccgtgtattactgtgcgagagggtcgggccgatattttgactggttatccccctctgatgcttttgatatctggggccaagggacaatggtcaccgtctcttcagcctccaccaagggcccatcggtcttccccctggcaccctcctccaagagcacctctggggcacagcggcctgggctgcctggtcaggactactctagtacgtga

SEQ ID NO: 447438 - DNA, 505 bp, Homo sapiens; identical to SEQ ID NO: 445664
  misc_feature: HEFZJCU01CZQY7.12.33.C11.1.454.heavy.3.raw

SEQ ID NO: 447439 - DNA, 483 bp, Homo sapiens; identical to SEQ ID NO: 444532
  misc_feature: HEFZJCU01DJ29N.47.59.F04.1.454.heavy.3.raw

SEQ ID NO: 447440 - DNA, 501 bp, Homo sapiens; identical to SEQ ID NO: 445341
  misc_feature: HEFZJCU01CO2P0.48.34.D01.1.454.heavy.3.raw

SEQ ID NO: 447441 - DNA, 481 bp, Homo sapiens
  misc_feature: HEFZJCU01ASWH4.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccagagcacctccgagagcacagcggccctgggctgcctggtcaaggactacttccactactatg

SEQ ID NO: 447442 - DNA, 395 bp, Homo sapiens; identical to SEQ ID NO: 446729
  misc_feature: HEFZJCU01BHBHV.47.46.E02.1.454.heavy.3.raw

SEQ ID NO: 447443 - DNA, 396 bp, Homo sapiens; identical to SEQ ID NO: 444469
  misc_feature: HEFZJCU01BL4Y9.47.46.E02.1.454.heavy.3.raw

SEQ ID NO: 447444 - DNA, 510 bp, Homo sapiens
  misc_feature: HEFZJCU01CTO9F.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttcccctggcgccctgctccaggagcacctccgagagcacagcggccctgggctgcctggtcaaggactactt

SEQ ID NO: 447445 - DNA, 373 bp, Homo sapiens
  misc_feature: HEFZJCU01D4VWO.5.23.C01.1.454.heavy.3.raw
atcagacacgcacgaccggtgctcgatttagtacacgtgattagggattggggagatctatcataccgggagcaccaactacaatccgtccctcaagagtcgagtcaccatatctatagaccacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 447446 - DNA, 398 bp, Homo sapiens; identical to SEQ ID NO: 444524
  misc_feature: HEFZJCU01ECWGJ.7.60.F05.1.454.heavy.3.raw

SEQ ID NO: 447447 - DNA, 519 bp, Homo sapiens; identical to SEQ ID NO: 444867
  misc_feature: HEFZJCU01CC7L9.9.34.D01.1.454.heavy.3.raw

SEQ ID NO: 447448 - DNA, 495 bp, Homo sapiens; identical to SEQ ID NO: 444618
  misc_feature: HEFZJCU01CXXDS.3.26.C04.1.454.heavy.3.raw

SEQ ID NO: 447449 - DNA, 382 bp, Homo sapiens
  misc_feature: HEFZJCU01DUIKG.53.27.C05.1.454.heavy.3.raw
cgcgtatacacacgaccggtgctcgatttagacgcgatcgaagggtggggggtcttgatcctgaaaatggtggaagagtctacgcgcagaagtttcagggcagagtcaccgtgacccaggacacatctagagacacagcctacatggaactcagaagcctgaggtctgaagacacggccgtctattattgtacaacccttgttgttcgggaggattgggctgacaattggttcgacccctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 447450 - DNA, 465 bp, Homo sapiens
  misc_feature: HEFZJCU01C88VF.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactatgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggccgccctgctccaggagcacctccgagagcacagcggccctgggctgcctgtcaaggactacttcccacgagagta

SEQ ID NO: 447451 - DNA, 465 bp, Homo sapiens; identical to SEQ ID NO: 445132
  misc_feature: HEFZJCU01DVJVD.5.86.H09.1.454.heavy.3.raw

SEQ ID NO: 447452 - DNA, 502 bp, Homo sapiens
  misc_feature: HEFZJCU01DLYE1.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagcgtggtttcgtgtaggctatttagaaggtgtccagtgtgaggtgcagctggtggagtcgtggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgagggccgattcatcatctccagagacaacgcgacaactcactgtctctgctgatgagcagcctgagagccgacgcacggctatctattctgtgcgaaactctcattccgtcatctgaatctgggccagggaaccctggtcgccg

SEQ ID NO: 447453 - DNA, 493 bp, Homo sapiens
  misc_feature: HEFZJCU01D44GW.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggtttcgcgtaggcgtctttaagtaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcaagactccctgaggggccgattcaccatctccagagacaattcccagaacacggtctatctgcacctgaccagcctgagaactgacgacactctctctaactactgtgcgagagagttgacgagtc

SEQ ID NO: 447454 - DNA, 524 bp, Homo sapiens; identical to SEQ ID NO: 445889
  misc_feature: HEFZJCU01ER3F3.18.33.C11.1.454.heavy.3.raw

SEQ ID NO: 447455 - DNA, 551 bp, Homo sapiens
  misc_feature: HEFZJCU01CECTG.16.28.C06.1.454.heavy.3.raw
tgtactactccacgaccggtgctcgatttagagctcacgtattgggtttgggctgagttggctttttcttgtggctattttaaaaggtgtccagtgtgaggtgcaactgttggagtctgggggagccttggtacagccgggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccaaggcccatcggtcttcccctggcgccctgctccagagcacctccgagaacacagcggccctggg

SEQ ID NO: 447456 - DNA, 535 bp, Homo sapiens
  misc_feature: HEFZJCU01DDLTS.18.59.F04.1.454.heavy.3.raw
tacgagtatgcacgaccggtgctcgatttagtacacacacttagggattggggggagaggagcccagccttgggattcccaagtgtttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacgtatggacctctggggccaagggga

SEQ ID NO: 447457 - DNA, 387 bp, Homo sapiens; identical to SEQ ID NO: 445229
  misc_feature: HEFZJCU01CFM6K.11.20.B09.1.454.heavy.3.raw

SEQ ID NO: 447458 - DNA, 486 bp, Homo sapiens; identical to SEQ ID NO: 444861
  misc_feature: HEFZJCU01A3VZ0.47.55.E11.1.454.heavy.3.raw

SEQ ID NO: 447459 - DNA, 390 bp, Homo sapiens; identical to SEQ ID NO: 444541
  misc_feature: HEFZJCU01DETZN.16.24.C02.1.454.heavy.3.raw

SEQ ID NO: 447460 - DNA, 427 bp, Homo sapiens; identical to SEQ ID NO: 444708
  misc_feature: HEFZJCU01BINPD.9.34.D01.1.454.heavy.3.raw

SEQ ID NO: 447461 - DNA, 499 bp, Homo sapiens
  misc_feature: HEFZJCU01D34OS.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctggggccaagggac

SEQ ID NO: 447462 - DNA, 494 bp, Homo sapiens
  misc_feature: HEFZJCU01D0MUT.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggtcgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctgggccaagggaccacagtcaccgtctcctcaacctccaccaaggcccatcggtcttccccctggcgccctgctccaggagcacctccgagagcacagcggccctgggctgcctggttaaggactacttccctacagtgct

SEQ ID NO: 447463 - DNA, 373 bp, Homo sapiens
  misc_feature: HEFZJCU01CRGV9.49.30.C08.1.454.heavy.3.raw
agtcgagagacacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggagccctggtcaccgtctcctcagcttccaccaagggcccatcggtcttccccctggcgccctgctccaggagcacctctgggggcacagcggccctgggctgcctggtcaaggactacttcctctctcgact

SEQ ID NO: 447464 - DNA, 509 bp, Homo sapiens; identical to SEQ ID NO: 444586
  misc_feature: HEFZJCU01BOSUS.12.78.H01.1.454.heavy.3.raw

SEQ ID NO: 447465 - DNA, 503 bp, Homo sapiens
  misc_feature: HEFZJCU01AV9D5.51.71.G05.1.454.heavy.3.raw
cgatcgtatacacgaccggtgctcgatttagtgtcgtcgcaagagagagggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctgggccaagggacaatggtcattgtctcttcagcctccaccaagggcccatcggtcttcccctggcaccctcctccaagagcacctctgggggcacagcggcctgggctgcttggtcaaggactacttcc

SEQ ID NO: 447466 - DNA, 429 bp, Homo sapiens
  misc_feature: HEFZJCU01EQADW.52.87.H10.1.454.heavy.3.raw
cgcagtacgacacgaccggtgctcgatttagcagtactgcgttgggttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctgggcccgggaatcccggtcaccgtctccccaggtgagtcatcaccacccccagcttccaccaagggcccatcggtcttccccctggcgccctgctccaggagcacctctgggggcacagcggccctgggctgcctggtcaaggactacttcctatacgatcg

SEQ ID NO: 447467 - DNA, 489 bp, Homo sapiens
  misc_feature: HEFZJCU01CB4N4.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctccaccaagggcccatcggtcttccccctggccaccctcctccaagagcacctcgtgggggcacagcggccctgggctgcctggtcaaggactacttccgagtagtaca

SEQ ID NO: 447468 - DNA, 521 bp, Homo sapiens
  misc_feature: HEFZJCU01E1EIT.49.78.H01.1.454.heavy.3.raw
agtcgagagacacgaccggtgctcgatttagtgtgagtagtttgggtttgggggggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccgggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacgccgccttcctactactgtgcaaaagattacggtaggaccaccacctacttttgtaccactgcggccacc

SEQ ID NO: 447469 - DNA, 450 bp, Homo sapiens
  misc_feature: HEFZJCU01D4BDN.52.5.A05.1.454.heavy.3.raw
cgcagtacgacacgaccggtgctcgatttagatagatagacaggggttgggggcaatttataaacccaaaaggacatggccatgcagcgggtagggacaatacagacagatatcagcctgaaatgtagcctcagggcacaggtgggcacgggcactgtccacctaagccaggggcagacccgagtgtccccgcagtagacctgagagcgctgggcccacagcctcccctcggtgccctgctacctcctcaggtcagccctgggcatcccgggtttccccagtcctggcgtgctacgatctggacgtctggggccaagggaccacggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 447470 - DNA, 515 bp, Homo sapiens
  misc_feature: HEFZJCU01DLZCY.53.70.G04.1.454.heavy.3.raw
cgcgtatacacacgaccggtgctcgatttagtgtagtgtgaagggaaagggtggagtctgggggagacttggtacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatgggacatctggggccgagggaccacgggtcaccgtctcctcagcctccaccaagggcccatcggtcttcccctggcgccctgctccaggagcacctccgagagcacagcggccctgggctgcctggtcaaggctactcctcg

SEQ ID NO: 447471 - DNA, 495 bp, Homo sapiens; identical to SEQ ID NO: 445359
  misc_feature: HEFZJCU01CESX7.4.21.B10.1.454.heavy.3.raw

SEQ ID NO: 447472 - DNA, 379 bp, Homo sapiens; identical to SEQ ID NO: 444450
  misc_feature: HEFZJCU01BHGXO.47.77.G11.1.454.heavy.3.raw

SEQ ID NO: 447473 - DNA, 479 bp, Homo sapiens
  misc_feature: HEFZJCU01DMFHP.48.15.B04.1.454.heavy.3.raw
agtatacatacacgaccggtgctcgatttagacagtatatatccgcgggcacgaccggtgctcgatttagtacacgtgattagggattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtgagtcgtggttcgacccctggggccagggtaccctggtcattgtctcctcagcttccaccaagggcccatcggtcttccccctggcgccctgctccaggagcacctctgggggcacagcggccctgggctgcctggtcaaggactacttcctatgtatact

SEQ ID NO: 447474 - DNA, 511 bp, Homo sapiens
  misc_feature: HEFZJCU01AI5W9.48.28.C06.1.454.heavy.3.raw
agtatacatacacgaccggtgctcgatttagagctcacgtattgggtttggggggtctcagagaggagccttagccctggactccaaggcctttccacttggtgatcagcactgagcacagaggactcaccatggaattggggctgagcgtggttttccttgttagctattttagaaggtgtccagtgtgaagtgcagctggtggagtctgggggaggcttggtccagcctggggggtccctaagactctcctgtgtagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttcccctggcgccctgctccaggagcacctccgagagcacagcggccctgggctgcct

SEQ ID NO: 447475 - DNA, 497 bp, Homo sapiens
  misc_feature: HEFZJCU01ADJGR.51.37.D04.1.454.heavy.3.raw
cgatcgtatacacgaccggtgctcgatttagtagcatactgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttcttttttactgtgcgccaggaagcagtggctc

SEQ ID NO: 447476 - DNA, 526 bp, Homo sapiens
  misc_feature: HEFZJCU01ATNCB.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcggccctgggctgcctggtcaaggactacttccg

SEQ ID NO: 447477 - DNA, 504 bp, Homo sapiens
  misc_feature: HEFZJCU01ADMJZ.51.71.G05.1.454.heavy.3.raw
cgatcgtatacacgaccggtgctcgatttagtgtcgtcgcaagagagagggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaacgagcacctctgggggcacagcggccctgggctgcctggtcaaggactactt

SEQ ID NO: 447478 - DNA, 555 bp, Homo sapiens
  misc_feature: HEFZJCU01CN14U.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacgggggggtactactacgctatggacgtctgggggccaagggaccacggtcaccgtctcctcagcctccaccaagggcccatcggtcttcccctcggtcaccctcctccaacgagcacctctgggggcacg

SEQ ID NO: 447479 - DNA, 521 bp, Homo sapiens
  misc_feature: HEFZJCU01EUT5O.12.71.G05.1.454.heavy.3.raw
  modified_base (478)..(478): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccaggggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttcccctggcgccctgctccaggagcacctccgagngcacagcggccctgggctgcctggtcaaggactacttcctacg

SEQ ID NO: 447480 - DNA, 316 bp, Homo sapiens; identical to SEQ ID NO: 444444
  misc_feature: HEFZJCU01DZD7V.47.56.F01.1.454.heavy.3.raw

SEQ ID NO: 447481 - DNA, 464 bp, Homo sapiens
  misc_feature: HEFZJCU01DEFNC.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttccacgagagta

SEQ ID NO: 447482 - DNA, 379 bp, Homo sapiens; identical to SEQ ID NO: 444450
  misc_feature: HEFZJCU01ETFVX.47.77.G11.1.454.heavy.3.raw

SEQ ID NO: 447483 - DNA, 509 bp, Homo sapiens; identical to SEQ ID NO: 445824
  misc_feature: HEFZJCU01A94CT.9.14.B03.1.454.heavy.3.raw

SEQ ID NO: 447484 - DNA, 531 bp, Homo sapiens; identical to SEQ ID NO: 446857
  misc_feature: HEFZJCU01ATY7Y.7.78.H01.1.454.heavy.3.raw

SEQ ID NO: 447485 - DNA, 483 bp, Homo sapiens
  misc_feature: HEFZJCU01EW6QT.40.71.G05.1.454.heavy.3.raw
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagcctgacatctgacgacacggccgtatattactgtgcgagagatcatcggaggtggaatgccgtgt

SEQ ID NO: 447486 - DNA, 508 bp, Homo sapiens; identical to SEQ ID NO: 444619
  misc_feature: HEFZJCU01AHRHK.3.81.H04.1.454.heavy.3.raw

SEQ ID NO: 447487 - DNA, 488 bp, Homo sapiens; identical to SEQ ID NO: 444651
  misc_feature: HEFZJCU01EBU45.16.67.G01.1.454.heavy.3.raw

SEQ ID NO: 447488 - DNA, 399 bp, Homo sapiens
  misc_feature: HEFZJCU01EJETJ.3.70.G04.1.454.heavy.3.raw
agacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagagattcgagtggttcggggacctcaccctggttctacttcgatctctggggccgtggcaccctggtcactgtctcctcagcctccaccaagggcccatcggtcttccccctggcgccctgctccaggagcacctccgagagcacagcggccctgggctgcctggtcaaggactacttccgagtgcgtct

SEQ ID NO: 447489 - DNA, 518 bp, Homo sapiens; identical to SEQ ID NO: 445423
  misc_feature: HEFZJCU01BO4EJ.7.78.H01.1.454.heavy.3.raw

SEQ ID NO: 447490 - DNA, 506 bp, Homo sapiens; identical to SEQ ID NO: 444696
  misc_feature: HEFZJCU01BBYAI.16.34.D01.1.454.heavy.3.raw

SEQ ID NO: 447491 - DNA, 491 bp, Homo sapiens
  misc_feature: HEFZJCU01AVUE5.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggccctgggctgcctggtcaaggactacttccctacagtgct

SEQ ID NO: 447492 - DNA, 519 bp, Homo sapiens; identical to SEQ ID NO: 446650
  misc_feature: HEFZJCU01BZ4IE.13.76.G10.1.454.heavy.3.raw

SEQ ID NO: 447493 - DNA, 504 bp, Homo sapiens
  misc_feature: HEFZJCU01BAQ4S.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgt

SEQ ID NO: 447494 - DNA, 396 bp, Homo sapiens; identical to SEQ ID NO: 444469
  misc_feature: HEFZJCU01CBAFP.47.46.E02.1.454.heavy.3.raw

SEQ ID NO: 447495 - DNA, 488 bp, Homo sapiens
  misc_feature: HEFZJCU01BV2KU.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgaacg

SEQ ID NO: 447496 - DNA, 489 bp, Homo sapiens; identical to SEQ ID NO: 444591
  misc_feature: HEFZJCU01CGYDJ.18.70.G04.1.454.heavy.3.raw

SEQ ID NO: 447497 - DNA, 491 bp, Homo sapiens
  misc_feature: HEFZJCU01CMOFO.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctgggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 447498 - DNA, 536 bp, Homo sapiens
  misc_feature: HEFZJCU01ENIRY.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgtacccctgggggccggggaacccgtggtcaccgtcctccccaccctccaacccg

SEQ ID NO: 447499 - DNA, 536 bp, Homo sapiens
  misc_feature: HEFZJCU01DPUUC.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaagggcccatcggtcttccccctggcaccctcctccaagagcacctctgggggcacagcggccctgggctgcctggtcaaggactacttcc

SEQ ID NO: 447500 - DNA, 423 bp, Homo sapiens; identical to SEQ ID NO: 444772
  misc_feature: HEFZJCU01DJW1C.16.78.H01.1.454.heavy.3.raw

SEQ ID NO: 447501 - DNA, 384 bp, Homo sapiens; identical to SEQ ID NO: 445564
  misc_feature: HEFZJCU01EGEXQ.47.29.C07.1.454.heavy.3.raw

SEQ ID NO: 447502 - DNA, 533 bp, Homo sapiens
  misc_feature: HEFZJCU01EFC7H.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggactctgggccg

SEQ ID NO: 447503 - DNA, 496 bp, Homo sapiens; identical to SEQ ID NO: 444697
  misc_feature: HEFZJCU01DL6JM.16.37.D04.1.454.heavy.3.raw

SEQ ID NO: 447504 - DNA, 509 bp, Homo sapiens
  misc_feature: HEFZJCU01CQADD.10.5.A05.1.454.heavy.3.raw
catagtagtgcacgaccggtgctcgatttagatagatagacagggggagtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatgcccggggaaggcctggagtggatggggatcatcaatcttggtagctctgaaaccagatacaccccgtccttccaaggccgggtcaccatctcagccgacaggtccatcagtactacctacttggagtggattagcctgaaggcctcggacaccgccatgtattactgtacgagacttgaacggggattctattatggcgcgatctggggccagggaaccctggtcaccg

SEQ ID NO: 447505 - DNA, 500 bp, Homo sapiens; identical to SEQ ID NO: 445811
  misc_feature: HEFZJCU01BK93X.48.34.D01.1.454.heavy.3.raw

SEQ ID NO: 447506 - DNA, 491 bp, Homo sapiens
  misc_feature: HEFZJCU01EISL7.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtc

SEQ ID NO: 447507 - DNA, 513 bp, Homo sapiens; identical to SEQ ID NO: 446452
  misc_feature: HEFZJCU01DA9TJ.17.33.C11.1.454.heavy.3.raw

SEQ ID NO: 447508 - DNA, 541 bp, Homo sapiens
  misc_feature: HEFZJCU01DKFY4.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtgcgtttctaggtggcttttaaaggtgccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggatcggggagtttggttcctggggccagggaaccctggtcaccg

SEQ ID NO: 447509 - DNA, 496 bp, Homo sapiens
  misc_feature: HEFZJCU01DLOUD.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgttattactgtgggagaaatcctagtggcta

SEQ ID NO: 447510 - DNA, 519 bp, Homo sapiens
  misc_feature: HEFZJCU01DURQK.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaatgaacaccctgcgagccgaggacacggccgtatattactgtgcgagaataacccgttcgcctggttattacc

SEQ ID NO: 447511 - DNA, 494 bp, Homo sapiens
  misc_feature: HEFZJCU01CP48Q.10.34.D01.1.454.heavy.3.raw
catagtagtgcacgaccggtgctcgatttagatcgtctgtgttgggtcccttagactctcctgtgcagcctctggattcactttcagtaacgcctggatgaactgggtcctccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgttctgatggcgtatgctctaaggaggaccttgacttctgggggccagggaaccctggtcaccgtctcctcagcctccaccaagggcccactcggtcttcccctggcgccctgctccaggagcacctccgacgagcacagcggccctgggctgcctggtcaaggactacttcccactactatg

SEQ ID NO: 447512 - DNA, 493 bp, Homo sapiens
  misc_feature: HEFZJCU01ESY5L.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggcgccctgctccagagcacctccgagagcacagcggcctgggctgcctggtcaaggactac

SEQ ID NO: 447513 - DNA, 513 bp, Homo sapiens
  misc_feature: HEFZJCU01DZQT9.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactacgtgggccagggaactctggtcaccgtctccgcagcctccaccaagggccc

SEQ ID NO: 447514 - DNA, 492 bp, Homo sapiens
  misc_feature: HEFZJCU01C0QH4.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgtttctagtggctattttaaaggtgtccagtgtgaggtgcagctgttggagtctgggggaggcttggcacagcctggggggtccctgagactctcctgtgcagcctctggattcatctttagcaactatggcatgacctgggtccgccaggctccagggaaggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttgg

SEQ ID NO: 447515 - DNA, 379 bp, Homo sapiens; identical to SEQ ID NO: 444450
  misc_feature: HEFZJCU01C4ES9.47.77.G11.1.454.heavy.3.raw

SEQ ID NO: 447516 - DNA, 374 bp, Homo sapiens
  misc_feature: HEFZJCU01AIXDH.51.64.F09.1.454.heavy.3.raw
cgatcgtatacacgaccggtgctcgatttagcgcgtatacaagggatttcagaggatggaattaagagatactatacagactccgtgaagggccgattcaccatctccagagacaattccaagaactcgctctatctgcaaatgagcagcctgagacctgaggacacggctgtctattactgtgcgaaacggaatgagtgggaactagggtttgagaacggtatggacgtctggggccgagggaccacggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 447517 - DNA, 384 bp, Homo sapiens; identical to SEQ ID NO: 444454
  misc_feature: HEFZJCU01BID42.11.61.F06.1.454.heavy.3.raw

SEQ ID NO: 447518 - DNA, 513 bp, Homo sapiens
  misc_feature: HEFZJCU01CMUZR.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccac

SEQ ID NO: 447519 - DNA, 497 bp, Homo sapiens; identical to SEQ ID NO: 445413
  misc_feature: HEFZJCU01DDQUC.16.37.D04.1.454.heavy.3.raw

SEQ ID NO: 447520 - DNA, 517 bp, Homo sapiens
  misc_feature: HEFZJCU01DSQB1.5.78.H01.1.454.heavy.3.raw
  modified_base (479)..(479): a, c, t, g, unknown or other
atcagacacgcacgaccggtgctcgatttagtgtgagtagtttgggtttggggggtgatcagcactgaacacagaggactcaccatggagtttgggctgagctgggtttcctcgttgctcttttaagaggtgtccagtgtcaggtgcagctggtggagtctgggggaggcgtggtccagcctgggaggtccctgagactctcctgtgcagcctctggattcaccttcagtagctatgactccgtgaagggccgattcaccatctccagagacaattccaagaacactctgtatctgcaaatggacagcctgagacctgaggacacggctgtgtattactgtgcgaaagaaaccggcgggcagtggctgggcccatttgaccactggggccagggaaccctggtcaccgtctcctcagcctccaccaagggcccatcggtcttcccctggcaccctcctccaagagcacctctgggggcncagcggccctgggctgcctggtcaaggactacttcccg

SEQ ID NO: 447521 - DNA, 503 bp, Homo sapiens
  misc_feature: HEFZJCU01EF29Y.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgt

SEQ ID NO: 447522 - DNA, 535 bp, Homo sapiens
  misc_feature: HEFZJCU01EYVP8.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtcttcccctggcaccctcctccaagagcacctctgggggcacagcggccctgggctg

SEQ ID NO: 447523 - DNA, 511 bp, Homo sapiens
  misc_feature: HEFZJCU01DRUGK.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggacaatggtcacgtctcttcagcctccaccaaggcccatcggtcttcccctggcaccctcctccaagagcacctctggggcacagcggcccg

SEQ ID NO: 447524 - DNA, 383 bp, Homo sapiens
  misc_feature: HEFZJCU01CL1LL.41.26.C04.1.454.heavy.3.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 447525 - DNA, 492 bp, Homo sapiens
  misc_feature: HEFZJCU01EZM4C.22.78.H01.1.454.heavy.3.raw
  modified_base (433)..(433): a, c, t, g, unknown or other
acatacgcgtcacgaccggtgctcgatttagtgtgagtagtttgggtttggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttcccctggcaccctcctccaagngcacctctggggcacagcggcctgggctgcctggtcaaggactacttccacgcgtatgt

SEQ ID NO: 447526 - DNA, 542 bp, Homo sapiens
  misc_feature: HEFZJCU01EZHFB.15.86.H09.1.454.heavy.3.raw
tctacgtagccacgaccggtgctcgatttagtgctatagacttggggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaacgacggtgtatttgcaaatgaacagcctgaaaccgaggacacagccgtctattactgtaccacagattcggaagtgcatcgacgtaaaggaggctatgcttttgatatctggggcccaggggac

SEQ ID NO: 447527 - DNA, 508 bp, Homo sapiens
  misc_feature: HEFZJCU01DP68X.51.13.B02.1.454.heavy.3.raw
cgatcgtatacacgaccggtgctcgatttagtctagcgacttccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctcccca

SEQ ID NO: 447528 - DNA, 435 bp, Homo sapiens
  misc_feature: HEFZJCU01E1629.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaaccaaagggcagccccgagaaccacaggtgtacaccctgcccccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 447529 - DNA, 384 bp, Homo sapiens; identical to SEQ ID NO: 444454
  misc_feature: HEFZJCU01CBPPB.11.61.F06.1.454.heavy.3.raw

SEQ ID NO: 447530 - DNA, 508 bp, Homo sapiens; identical to SEQ ID NO: 446002
  misc_feature: HEFZJCU01BGOWO.9.78.H01.1.454.heavy.3.raw

SEQ ID NO: 447531 - DNA, 499 bp, Homo sapiens; identical to SEQ ID NO: 446805
  misc_feature: HEFZJCU01EJ60Q.3.20.B09.1.454.heavy.3.raw

SEQ ID NO: 447532 - DNA, 505 bp, Homo sapiens
  misc_feature: HEFZJCU01C6MZ4.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggccctgggctgcctggtcaggactactccgta

SEQ ID NO: 447533 - DNA, 516 bp, Homo sapiens; identical to SEQ ID NO: 445176
  misc_feature: HEFZJCU01D3D78.14.66.F11.1.454.heavy.3.raw

SEQ ID NO: 447534 - DNA, 491 bp, Homo sapiens; identical to SEQ ID NO: 445531
  misc_feature: HEFZJCU01EK5G4.11.38.D05.1.454.heavy.3.raw

SEQ ID NO: 447535 - DNA, 505 bp, Homo sapiens
  misc_feature: HEFZJCU01EL936.22.86.H09.1.454.heavy.3.raw
acatacgcgtcacgaccggtgctcgatttagtgctatagacttgggtttgggctgagcgtggttttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggcgccctgctcc

SEQ ID NO: 447536 - DNA, 519 bp, Homo sapiens
  misc_feature: HEFZJCU01CQINB.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcaccgtctccgcagcctccacc

SEQ ID NO: 447537 - DNA, 371 bp, Homo sapiens; identical to SEQ ID NO: 444435
  misc_feature: HEFZJCU01BN3TR.3.42.D09.1.454.heavy.3.raw

SEQ ID NO: 447538 - DNA, 492 bp, Homo sapiens; identical to SEQ ID NO: 446787
  misc_feature: HEFZJCU01CJ8HE.4.7.A07.1.454.heavy.3.raw

SEQ ID NO: 447539 - DNA, 531 bp, Homo sapiens
  misc_feature: HEFZJCU01BYTDO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactagtgggggtcttgttcgtggggccgaggggaccctggtcatcgtctccccagcctccaccaacgggcccatccggtccttcccccgtggccg

SEQ ID NO: 447540 - DNA, 505 bp, Homo sapiens
  misc_feature: HEFZJCU01D5ARC.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaaggcccatcggtcttcccctggcaccctcctccaagagcacctctgggggcacagcggccctgggctgcctggtcaaggactacttccgagtagtaca

SEQ ID NO: 447541 - DNA, 512 bp, Homo sapiens
  misc_feature: HEFZJCU01DD5AP.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccaggagcacctctggggcacagcggcccg

SEQ ID NO: 447542 - DNA, 504 bp, Homo sapiens
  misc_feature: HEFZJCU01DEVKH.13.55.E11.1.454.heavy.3.raw
tcacgtactacacgaccggtgctcgatttagcactcgcacgttgggtttgggggggtctcagagaggagccttagccctggactccaaggcctttccacttggtgatcagcactgagcacagaggactcaccatggaattggggctgagcgtggtggctacgttgtgctatttagaaggtggccagtgtgagatgcgactggtggagtctgggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagtttccagacggcg

SEQ ID NO: 447543 - DNA, 521 bp, Homo sapiens
  misc_feature: HEFZJCU01B82SI.14.14.B03.1.454.heavy.3.raw
cgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagtttggggctttttggaccactgggggccagggaaccctggtcaccgtctcttcagcctccaccaagggcccatcggtcttcccctggcaccctcctccaagagcacctctc

SEQ ID NO: 447544 - DNA, 450 bp, Homo sapiens
  misc_feature: HEFZJCU01ATYNE.10.38.D05.1.454.heavy.3.raw
catagtagtgcacgaccggtgctcgatttagtatctgatagttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 447545 - DNA, 489 bp, Homo sapiens; identical to SEQ ID NO: 444791
  misc_feature: HEFZJCU01CGW7P.47.85.H08.1.454.heavy.3.raw

SEQ ID NO: 447546 - DNA, 402 bp, Homo sapiens
  misc_feature: HEFZJCU01CSIEQ.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctgggccagggagccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 447547 - DNA, 491 bp, Homo sapiens
  misc_feature: HEFZJCU01B0UJZ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagccggccctgggctgccctggtcaaggactacttcccatactcgta

SEQ ID NO: 447548 - DNA, 482 bp, Homo sapiens; identical to SEQ ID NO: 444503
  misc_feature: HEFZJCU01BVD6I.7.10.A10.1.454.heavy.3.raw

SEQ ID NO: 447549 - DNA, 375 bp, Homo sapiens; identical to SEQ ID NO: 444459
  misc_feature: HEFZJCU01COU1V.48.59.F04.1.454.heavy.3.raw

SEQ ID NO: 447550 - DNA, 523 bp, Homo sapiens
  misc_feature: HEFZJCU01A329H.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagcggccctgggctgcctggtcaaggactacttccttaccg

SEQ ID NO: 447551 - DNA, 527 bp, Homo sapiens
  misc_feature: HEFZJCU01CY7LN.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctcggtcaccctcctcccaagacgcacctctcggggggcacgac

SEQ ID NO: 447552 - DNA, 504 bp, Homo sapiens
  misc_feature: HEFZJCU01CH7AD.52.34.D01.1.454.heavy.3.raw
cgcagtacgacacgaccggtgctcgatttagatcgtctgtgttgggttggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 447553 - DNA, 479 bp, Homo sapiens
  misc_feature: HEFZJCU01DW0UC.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctgtcaaggactacttccacgcgtatgt

SEQ ID NO: 447554 - DNA, 395 bp, Homo sapiens
  misc_feature: HEFZJCU01C3CGL.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttcccctggcaccctcctccaagagcacctctgggggcacagcggccctgggctgcctggtcaaggactacttcccatactcgta

SEQ ID NO: 447555 - DNA, 506 bp, Homo sapiens
  misc_feature: HEFZJCU01CLVZF.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactctggggccg

SEQ ID NO: 447556 - DNA, 511 bp, Homo sapiens
  misc_feature: HEFZJCU01CK6TE.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 447557 - DNA, 507 bp, Homo sapiens
  misc_feature: HEFZJCU01EHTD6.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggttatttcgatctctggggccgtggcaccctggtcactgtctcctcggcttccaccaagggcccatcggtcttcccctggcgccctgctccaggagcacctcgtgggggcac

SEQ ID NO: 447558 - DNA, 487 bp, Homo sapiens
  misc_feature: HEFZJCU01CM31V.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggccatcggtcttcccctggcgccctgctccaggagcacctccgagagcacagcggccctgggctgcctggtcaaggactacttcccatactcgta

SEQ ID NO: 447559 - DNA, 397 bp, Homo sapiens
  misc_feature: HEFZJCU01EKXB3.47.46.E02.1.454.heavy.3.raw
agctcacgtacacgaccggtgctcgatttagactcatctacaggggaaggggcgtggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 447560 - DNA, 524 bp, Homo sapiens
  misc_feature: HEFZJCU01AZCWH.40.43.D10.1.454.heavy.3.raw
tctagcgactcacgaccggtgctcgatttagactagcagtaagggggctctgagagaggagcccagccctgggattttcaggtgttttcatttggtgatcaggactgaacagagagaactcaccatggagtttgggctgagcgtgcgttttctaggtggctattttaaaaggtgtccagtgtgaggtgcagttcgttggagtctgggggaggcttggcacagcctggggggtcccggagactctcctgtgcagcctctggattcgcctttcagaactctgccatgcactgggtccgccagcctccagggaaggggctggagtgggtctcaggtattcggggtgatggtactgacacatactacgcagactctgcgaagggccggttcaccatctccagagacatttccaagaacacactctatctgcaaatgaccaacctcagaggcgagggacacgggccatatatttactgtgcgaaaggtggtgactatgaccactgggggccaggggaacccctgggtcc

SEQ ID NO: 447561 - DNA, 497 bp, Homo sapiens
  misc_feature: HEFZJCU01ENSLR.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattac

SEQ ID NO: 447562 - DNA, 400 bp, Homo sapiens; identical to SEQ ID NO: 444452
  misc_feature: HEFZJCU01EMANY.47.24.C02.1.454.heavy.3.raw

SEQ ID NO: 447563 - DNA, 463 bp, Homo sapiens; identical to SEQ ID NO: 446208
  misc_feature: HEFZJCU01D8IIJ.19.10.A10.1.454.heavy.3.raw

SEQ ID NO: 447564 - DNA, 506 bp, Homo sapiens; identical to SEQ ID NO: 444732
  misc_feature: HEFZJCU01B41Z6.14.78.H01.1.454.heavy.3.raw

SEQ ID NO: 447565 - DNA, 517 bp, Homo sapiens
  misc_feature: HEFZJCU01CQ1UG.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtacgagacttcctacgacgtacgtactctacgtagcgggccggtcgtcgacgacggccgact

SEQ ID NO: 447566 - DNA, 521 bp, Homo sapiens; identical to SEQ ID NO: 447111
  misc_feature: HEFZJCU01CSP3J.16.86.H09.1.454.heavy.3.raw

SEQ ID NO: 447567 - DNA, 507 bp, Homo sapiens; identical to SEQ ID NO: 446637
  misc_feature: HEFZJCU01CA0A3.16.34.D01.1.454.heavy.3.raw

SEQ ID NO: 447568 - DNA, 390 bp, Homo sapiens
  misc_feature: HEFZJCU01DJ14Q.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttcccctggcgccctgctccaggagcacctccgagagcacagcggccctgggctgcctggtcaaggactacttcctacgtcgtat

SEQ ID NO: 447569 - DNA, 388 bp, Homo sapiens
  misc_feature: HEFZJCU01AYGP9.52.34.D01.1.454.heavy.3.raw
cgcagtacgacacgaccggtgctcgatttagatcgtctgtgctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgccccattggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 447570 - DNA, 505 bp, Homo sapiens
  misc_feature: HEFZJCU01DAWXF.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccgattcaccatctccagagaaaatggcaagaactccttgtatcttcaaatgaacagcctgagagccggggacgacggcggtgtattactgtgtaagagagctcgatggtaacaggggacttaat

SEQ ID NO: 447571 - DNA, 402 bp, Homo sapiens
  misc_feature: HEFZJCU01DXW9H.47.24.C02.1.454.heavy.3.raw
agctcacgtacacgaccggtgctcgatttagtacagatcgttagggaaagggactgggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgcctccaggagcacctccgagagcacagcggccctgggctgcctggtcaaggactacttcctacgtgagct

SEQ ID NO: 447572 - DNA, 521 bp, Homo sapiens; identical to SEQ ID NO: 446385
  misc_feature: HEFZJCU01D1BMA.9.63.F08.1.454.heavy.3.raw

SEQ ID NO: 447573 - DNA, 324 bp, Homo sapiens; identical to SEQ ID NO: 444475
  misc_feature: HEFZJCU01ERWCB.18.17.B06.1.454.heavy.3.raw

SEQ ID NO: 447574 - DNA, 526 bp, Homo sapiens; identical to SEQ ID NO: 447476
  misc_feature: HEFZJCU01EV4RY.14.55.E11.1.454.heavy.3.raw

SEQ ID NO: 447575 - DNA, 333 bp, Homo sapiens
  misc_feature: HEFZJCU01AVC00.40.81.H04.1.454.heavy.3.raw
tctagcgactcacgaccggtgctcgatttagtagtgtagattcgcgggtgtccttgggttttggggggaagaggaagactgacggtcctgccacagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 447576 - DNA, 379 bp, Homo sapiens; identical to SEQ ID NO: 444450
  misc_feature: HEFZJCU01CX20J.47.77.G11.1.454.heavy.3.raw

SEQ ID NO: 447577 - DNA, 519 bp, Homo sapiens; identical to SEQ ID NO: 445330
  misc_feature: HEFZJCU01CSTV9.7.78.H01.1.454.heavy.3.raw

SEQ ID NO: 447578 - DNA, 400 bp, Homo sapiens
  misc_feature: HEFZJCU01EWSGD.4.77.G11.1.454.heavy.3.raw
agcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgagagcacagcggccctgggctgcctggtcaaggactacttccctacggtgct

SEQ ID NO: 447579 - DNA, 529 bp, Homo sapiens
  misc_feature: HEFZJCU01EDCPD.40.70.G04.1.454.heavy.3.raw
tctagcgactcacgaccggtgctcgatttagtgtagtgtgaagggaaagggtctccgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaagggaccacggttaccgtctcctcagcctccaccaagggcccatcggtcttcccctggcgccctgctccaggagcacctccgagagcacagcggccctgggctgcctggtcaaggactacttccagtcgctaga

SEQ ID NO: 447580 - DNA, 519 bp, Homo sapiens; identical to SEQ ID NO: 445330
  misc_feature: HEFZJCU01E2D1Z.7.78.H01.1.454.heavy.3.raw

SEQ ID NO: 447581 - DNA, 518 bp, Homo sapiens
  misc_feature: HEFZJCU01BMCAS.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 447582 - DNA, 482 bp, Homo sapiens; identical to SEQ ID NO: 444503
  misc_feature: HEFZJCU01CEUJL.7.10.A10.1.454.heavy.3.raw

SEQ ID NO: 447583 - DNA, 505 bp, Homo sapiens
  misc_feature: HEFZJCU01ERB41.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttggtccctggggccgggaacccgggtc

SEQ ID NO: 447584 - DNA, 412 bp, Homo sapiens; identical to SEQ ID NO: 444705
  misc_feature: HEFZJCU01AJ44A.51.60.F05.1.454.heavy.3.raw

SEQ ID NO: 447585 - DNA, 381 bp, Homo sapiens
  misc_feature: HEFZJCU01EUN2J.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattagttgtgttaaatgggatgggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 447586 - DNA, 490 bp, Homo sapiens
  misc_feature: HEFZJCU01CAD77.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgccctggtaaggactacttcccatactcgta

SEQ ID NO: 447587 - DNA, 482 bp, Homo sapiens; identical to SEQ ID NO: 444503
  misc_feature: HEFZJCU01B21UO.7.10.A10.1.454.heavy.3.raw

SEQ ID NO: 447588 - DNA, 395 bp, Homo sapiens; identical to SEQ ID NO: 444517
  misc_feature: HEFZJCU01CBD6S.16.68.G02.1.454.heavy.3.raw

SEQ ID NO: 447589 - DNA, 450 bp, Homo sapiens; identical to SEQ ID NO: 444893
  misc_feature: HEFZJCU01C4ECC.53.57.F02.1.454.heavy.3.raw

SEQ ID NO: 447590 - DNA, 404 bp, Homo sapiens
  misc_feature: HEFZJCU01B7QL3.52.87.H10.1.454.heavy.3.raw
cgcagtacgacacgaccggtgctcgatttagcagtactgcgttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 447591 - DNA, 543 bp, Homo sapiens
  misc_feature: HEFZJCU01DY1L2.48.3.A03.1.454.heavy.3.raw
agtatacatacacgaccggtgctcgatttagagagcgtcacagggggctctgagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtactttgaactctggggtcagggaaccctgggtcaccgtctcctcag

SEQ ID NO: 447592 - DNA, 496 bp, Homo sapiens
  misc_feature: HEFZJCU01EXZMO.51.28.C06.1.454.heavy.3.raw
cgatcgtatacacgaccggtgctcgatttagagctcacgtattgggtttgggggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacagctcgaagaatacggttcttctacaaatgaacagcctgagagctgaggacacggctatgttttactgtgcgagagggaactcgattacagcag

SEQ ID NO: 447593 - DNA, 505 bp, Homo sapiens
  misc_feature: HEFZJCU01DZNNO.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcgtcaccgtctcctcagcctccaccaagggcccatcggtcttcccctggcg

SEQ ID NO: 447594 - DNA, 484 bp, Homo sapiens; identical to SEQ ID NO: 445311
  misc_feature: HEFZJCU01EG2L7.11.23.C01.1.454.heavy.3.raw

SEQ ID NO: 447595 - DNA, 395 bp, Homo sapiens
  misc_feature: HEFZJCU01B7K7A.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctggactgcctggtcaaggactacttccgagtagtaca

SEQ ID NO: 447596 - DNA, 481 bp, Homo sapiens
  misc_feature: HEFZJCU01DFNTF.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggcctgggctgcctggtcaggactacttcccactactatg

SEQ ID NO: 447597 - DNA, 495 bp, Homo sapiens; identical to SEQ ID NO: 446614
  misc_feature: HEFZJCU01ELYU2.13.85.H08.1.454.heavy.3.raw

SEQ ID NO: 447598 - DNA, 432 bp, Homo sapiens; identical to SEQ ID NO: 444920
  misc_feature: HEFZJCU01EE15H.11.39.D06.1.454.heavy.3.raw

SEQ ID NO: 447599 - DNA, 505 bp, Homo sapiens; identical to SEQ ID NO: 445664
  misc_feature: HEFZJCU01DHEQW.12.33.C11.1.454.heavy.3.raw

SEQ ID NO: 447600 - DNA, 517 bp, Homo sapiens
  misc_feature: HEFZJCU01BZJDA.13.61.F06.1.454.heavy.3.raw
tcacgtactacacgaccggtgctcgatttagctacgctctaagggaaagggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttcccctggcgccctgctccaggagcacctctgggggcacagcggccctgggctgcctggtcaaggactacttccgtactagacg

SEQ ID NO: 447601 - DNA, 391 bp, Homo sapiens; identical to SEQ ID NO: 444514
  misc_feature: HEFZJCU01D8NWR.12.24.C02.1.454.heavy.3.raw

SEQ ID NO: 447602 - DNA, 494 bp, Homo sapiens
  misc_feature: HEFZJCU01CW73M.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactac

SEQ ID NO: 447603 - DNA, 509 bp, Homo sapiens; identical to SEQ ID NO: 445824
  misc_feature: HEFZJCU01CJ36Q.9.14.B03.1.454.heavy.3.raw

SEQ ID NO: 447604 - DNA, 525 bp, Homo sapiens
  misc_feature: HEFZJCU01CYR6T.12.40.D07.1.454.heavy.3.raw
  modified_base (360)..(360): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcccgtgacgactacggcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattcaagaacaccctttanctgcaaatagacagcctgagaccagacgacacggctgtctattattgcgcgagagagacacaacgaacctactggccaatactatgggggcttgttctggggccaggggaccctggtcatcgtctccccagcctccaccaagggcccatcggtcttcccctggcg

SEQ ID NO: 447605 - DNA, 465 bp, Homo sapiens
  misc_feature: HEFZJCU01CF6Y0.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 447606 - DNA, 490 bp, Homo sapiens
  misc_feature: HEFZJCU01CT9VQ.19.53.E09.1.454.heavy.3.raw
tactctcgtgcacgaccggtgctcgatttagagagagtgtgttgagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactgggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 447607 - DNA, 476 bp, Homo sapiens
  misc_feature: HEFZJCU01BATJB.10.38.D05.1.454.heavy.3.raw
catagtagtgcacgaccggtgctcgatttagtatctgatagttgggtttggggggaagaggaagactgagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 447608 - DNA, 506 bp, Homo sapiens; identical to SEQ ID NO: 444696
  misc_feature: HEFZJCU01ERK5H.16.34.D01.1.454.heavy.3.raw

SEQ ID NO: 447609 - DNA, 351 bp, Homo sapiens
  misc_feature: HEFZJCU01DCOSB.49.12.B01.1.454.heavy.3.raw
agtcgagagacacgaccggtgctcgatttagtagtgtagattccgcgggcacgaccggtgctcgatttagtcactctacagggacaattccgagaacacgctgtatctgcagatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 447610 - DNA, 401 bp, Homo sapiens
  misc_feature: HEFZJCU01BUWJE.14.60.F05.1.454.heavy.3.raw
cgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcggggttcgacccctggggccagggaaccctggtcaccgtctcctcagcttccaccaagggcccatcggtcttccccctggcgccctgctccaggagcacctctggggcacagcggccctgggctgcctggtcaaggactacttccgtactagacg

SEQ ID NO: 447611 - DNA, 518 bp, Homo sapiens
  misc_feature: HEFZJCU01CEFPN.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaatgaacagcctgagagtcgaagacacgggtatttattattgtgtgcgagatctggatttccttcgaaatgaagtgtggttcgatgtgtttg

SEQ ID NO: 447612 - DNA, 483 bp, Homo sapiens
  misc_feature: HEFZJCU01AHWMP.16.10.A10.1.454.heavy.3.raw
tgtactactccacgaccggtgctcgatttagcgtcgatctcagggggtccctgagactctcctgtgcagcctctggattcacccttagcggttatgccatgtagctgggtcccgccaggctccagggaaggggctggagtgggtctcgaacttttagtggtagtggtggtcaacgcctactacgcagagtccgtgaagggccgattcaccatctccagagactacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacaggcggccctgggctgcctggtcaaggactacttccgagtagtaca

SEQ ID NO: 447613 - DNA, 384 bp, Homo sapiens; identical to SEQ ID NO: 444454
  misc_feature: HEFZJCU01COE65.11.61.F06.1.454.heavy.3.raw

SEQ ID NO: 447614 - DNA, 517 bp, Homo sapiens
  misc_feature: HEFZJCU01BJB7Y.48.67.G01.1.454.heavy.3.raw
agtatacatacacgaccggtgctcgatttagagtatacatattgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaaggggggagcagctcgtccatccacttcgactccgtgggccagggaacctggtcaccgtctcctcagcctccaccgaacggcccagtcggtccttccccctggccaccctcctccaagagcacctcgtc

SEQ ID NO: 447615 - DNA, 498 bp, Homo sapiens
  misc_feature: HEFZJCU01EA487.3.26.C04.1.454.heavy.3.raw
  modified_base (451)..(451): a, c, t, g, unknown or other
agacgcactccacgaccggtgctcgatttagtctagcgactttgggtttggggggaagaggaagactgacggtccagcctgggagggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggancacctccgagagcacagcggccctgggctgcctggtcaaggactacg

SEQ ID NO: 447616 - DNA, 400 bp, Homo sapiens
  misc_feature: HEFZJCU01CDC7L.4.77.G11.1.454.heavy.3.raw
agcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgagagcacagcggccctgggctgcctggtcaaggactacttccctacagtgct

SEQ ID NO: 447617 - DNA, 435 bp, Homo sapiens; identical to SEQ ID NO: 447528
  misc_feature: HEFZJCU01ERXJW.9.30.C08.1.454.heavy.3.raw

SEQ ID NO: 447618 - DNA, 506 bp, Homo sapiens
  misc_feature: HEFZJCU01ESMKD.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacaccttattttga

SEQ ID NO: 447619 - DNA, 423 bp, Homo sapiens; identical to SEQ ID NO: 444772
  misc_feature: HEFZJCU01D4K9F.16.78.H01.1.454.heavy.3.raw

SEQ ID NO: 447620 - DNA, 498 bp, Homo sapiens
  misc_feature: HEFZJCU01DO96I.48.34.D01.1.454.heavy.3.raw
agtatacatacacgaccggtgctcgatttagatcgtctgtgttgggtttggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 447621 - DNA, 502 bp, Homo sapiens
  misc_feature: HEFZJCU01EQOTY.10.35.D02.1.454.heavy.3.raw
catagtagtgcacgaccggtgctcgatttagcacacgatagttgggtttgggggaggcttggttaagccggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 447622 - DNA, 506 bp, Homo sapiens; identical to SEQ ID NO: 444732
  misc_feature: HEFZJCU01C1YED.14.78.H01.1.454.heavy.3.raw

SEQ ID NO: 447623 - DNA, 504 bp, Homo sapiens
  misc_feature: HEFZJCU01CAEG8.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctcggcgccctgctccaggagcacctctggggc

SEQ ID NO: 447624 - DNA, 498 bp, Homo sapiens
  misc_feature: HEFZJCU01EX8EO.40.81.H04.1.454.heavy.3.raw
tctagcgactcacgaccggtgctcgatttagtagtgtagattcgcgggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgacc

SEQ ID NO: 447625 - DNA, 513 bp, Homo sapiens; identical to SEQ ID NO: 446452
  misc_feature: HEFZJCU01COMXS.17.33.C11.1.454.heavy.3.raw

SEQ ID NO: 447626 - DNA, 469 bp, Homo sapiens
  misc_feature: HEFZJCU01B91B9.15.34.D01.1.454.heavy.3.raw
tctacgtagccacgaccggtgctcgatttagatcgtctgtgttgggtttggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggagggccggagtggtatttggatactttctggggccaggggaccctggtcaccgtctcctcagcctccaccaagggcccatcggtcttccccctggcgccctgctccaggagcacctccgagagcacagcggccctgggctgcctggtcaaggactacttccgctacgtaga

SEQ ID NO: 447627 - DNA, 477 bp, Homo sapiens; identical to SEQ ID NO: 444659
  misc_feature: HEFZJCU01CZBT0.16.10.A10.1.454.heavy.3.raw

SEQ ID NO: 447628 - DNA, 510 bp, Homo sapiens
  misc_feature: HEFZJCU01DEXC4.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaaggacaatgtcacgtctcttcagcctccaccaagggcccatcggtcttcccctggcaccctcctccaagagcacctctggggcacagcggcccg

SEQ ID NO: 447629 - DNA, 437 bp, Homo sapiens
  misc_feature: HEFZJCU01DU3AP.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctatgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 447630 - DNA, 336 bp, Homo sapiens; identical to SEQ ID NO: 444510
  misc_feature: HEFZJCU01DG8F5.3.31.C09.1.454.heavy.3.raw

SEQ ID NO: 447631 - DNA, 491 bp, Homo sapiens; identical to SEQ ID NO: 446954
  misc_feature: HEFZJCU01AK3AK.17.16.B05.1.454.heavy.3.raw

SEQ ID NO: 447632 - DNA, 437 bp, Homo sapiens; identical to SEQ ID NO: 447018
  misc_feature: HEFZJCU01D4Q3F.40.27.C05.1.454.heavy.3.raw

SEQ ID NO: 447633 - DNA, 490 bp, Homo sapiens; identical to SEQ ID NO: 446494
  misc_feature: HEFZJCU01BQ8MB.11.13.B02.1.454.heavy.3.raw

SEQ ID NO: 447634 - DNA, 528 bp, Homo sapiens
  misc_feature: HEFZJCU01COPG8.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacaggaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatggaaccccggtcc

SEQ ID NO: 447635 - DNA, 514 bp, Homo sapiens
  misc_feature: HEFZJCU01ARPWE.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctggggcacagcggcccg

SEQ ID NO: 447636 - DNA, 400 bp, Homo sapiens; identical to SEQ ID NO: 444452
  misc_feature: HEFZJCU01DD173.47.24.C02.1.454.heavy.3.raw

SEQ ID NO: 447637 - DNA, 498 bp, Homo sapiens
  misc_feature: HEFZJCU01CWOLU.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgaccctggggccgagggaacccatgtcaccgtctcctcagcctccaccaagggcccatcggtcttcccctcggcgccctgctccaggagcacctccgagaacacagcggccctgggctgcctggtcaaggactacttccctacagtgct

SEQ ID NO: 447638 - DNA, 466 bp, Homo sapiens
  misc_feature: HEFZJCU01DL4YS.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggccgccctgctccaggagcacctccgagagcacagcggccctgggctgcctggtcaaggactacttcccacgagagta

SEQ ID NO: 447639 - DNA, 518 bp, Homo sapiens
  misc_feature: HEFZJCU01B29AE.49.39.D06.1.454.heavy.3.raw
agtcgagagacacgaccggtgctcgatttagtgacatctcgcagttctttgggttttcctcgttgctcttttaagaggtgtccagtgtcaggtgcaactggtggagtctgggggaggcgtggtccagcctgggaggtccctgagactctcctgtgcagcctctggatttaccttcagcagctatgctatgcactggttccgccaggctccaggcaaggggctggagtgggtggcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgattactacccgaaggactactgggccgagggaacccgtggtcaccgtctcctcagcctccaccaagggcccatcggtcttcccctcggcacccctcctccaagagcacctctgggggcacagcggctcg

SEQ ID NO: 447640 - DNA, 395 bp, Homo sapiens; identical to SEQ ID NO: 446729
  misc_feature: HEFZJCU01DIB56.47.46.E02.1.454.heavy.3.raw

SEQ ID NO: 447641 - DNA, 499 bp, Homo sapiens
  misc_feature: HEFZJCU01C3E7X.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccaggggaaccctgggtcaccgtctcctcagcctccaccg

SEQ ID NO: 447642 - DNA, 392 bp, Homo sapiens; identical to SEQ ID NO: 444456
  misc_feature: HEFZJCU01DEIGT.7.60.F05.1.454.heavy.3.raw

SEQ ID NO: 447643 - DNA, 481 bp, Homo sapiens
  misc_feature: HEFZJCU01B6MG9.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctgggctgcctggtcaaggactactccgtatctctcg

SEQ ID NO: 447644 - DNA, 504 bp, Homo sapiens
  misc_feature: HEFZJCU01AOFQU.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttg

SEQ ID NO: 447645 - DNA, 480 bp, Homo sapiens
  misc_feature: HEFZJCU01B1JGF.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctgtcaaggactacttccacgcgtatgt

SEQ ID NO: 447646 - DNA, 496 bp, Homo sapiens
  misc_feature: HEFZJCU01ERRTM.40.34.D01.1.454.heavy.3.raw
tctagcgactcacgaccggtgctcgatttagatcgtctgtgccgaggtgcagctggtgcagtctggagcagaggtgaaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttcccctggcgccctgctccaggagcacctctgggggcacagcggccctgggctgcctggtcaggactacttccagtcgctaga

SEQ ID NO: 447647 - DNA, 491 bp, Homo sapiens; identical to SEQ ID NO: 445531
  misc_feature: HEFZJCU01AGWPY.11.38.D05.1.454.heavy.3.raw

SEQ ID NO: 447648 - DNA, 491 bp, Homo sapiens
  misc_feature: HEFZJCU01DOPBW.10.34.D01.1.454.heavy.3.raw
catagtagtgcacgaccggtgctcgatttagatcgtctgtgttgggtcccttagactctcctgtgcagcctctggattcactttcagtaacgcctggatgaactgggtcctccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgttctgatggcgtatgctctaaggaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatg

SEQ ID NO: 447649 - DNA, 518 bp, Homo sapiens
  misc_feature: HEFZJCU01A3FMX.49.39.D06.1.454.heavy.3.raw
agtcgagagacacgaccggtgctcgatttagtgacatctcgcagttctttgggttttcctcgttgctcttttaagaggtgtccagtgtcaggtgcaactggtggagtctgggggaggcgtggtccagcctgggaggtccctgagactctcctgtgcagcctctggatttaccttcagcagctatgctatgcactggttccgccaggctccaggcaaggggctggagtgggtggcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgattactaccgaaggactactgggccagggaaccctggtcaccgtctcctcagcctccaccaacgggcccatcggtcttcccctcggccaccctcctccaagagcacctctgggggcacagcggcccgtc

SEQ ID NO: 447650 - DNA, 395 bp, Homo sapiens
  misc_feature: HEFZJCU01CY8H3.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctacggacacggccctttattactgtgcgcgagggcccctatcgagtgactatgatcccaggccctttgactcctggggccagggaaccttggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 447651 - DNA, 531 bp, Homo sapiens
  misc_feature: HEFZJCU01EPA83.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaggggcccatcggtcttcccctggcaccctcctccaagagcacctctgggggcacagcggccctgggctgcct

SEQ ID NO: 447652 - DNA, 509 bp, Homo sapiens
  misc_feature: HEFZJCU01AG8SE.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacacagccgtctattactgtgttagggagttttacgtatttttggt

SEQ ID NO: 447653 - DNA, 508 bp, Homo sapiens
  misc_feature: HEFZJCU01A7NFD.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagagcacctctgggggcacagcggccctgggctgcctggtcaaggactacttccgta

SEQ ID NO: 447654 - DNA, 520 bp, Homo sapiens
  misc_feature: HEFZJCU01D5NJO.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattacc

SEQ ID NO: 447655 - DNA, 502 bp, Homo sapiens
  misc_feature: HEFZJCU01BWBGR.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttcccctcggcgccctgctccaggagcacctccgagagcacagcggccctgggctgcctggtcaaggactacttccagtatagtct

SEQ ID NO: 447656 - DNA, 519 bp, Homo sapiens
  misc_feature: HEFZJCU01CFD3V.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctgggtcaccgtctcctcagcctccaccaagggcccatcggtcttcccctggcaccctcctccaagagcacctctgggggcacagcggccctgggctgcctggtcaaggactacttcctagagacacg

SEQ ID NO: 447657 - DNA, 429 bp, Homo sapiens
  misc_feature: HEFZJCU01DJFH4.40.34.D01.1.454.heavy.3.raw
tctagcgactcacgaccggtgctcgatttagatcgtctgtgttgggtttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 447658 - DNA, 494 bp, Homo sapiens
  misc_feature: HEFZJCU01AVPWB.4.21.B10.1.454.heavy.3.raw
agcactgtagcacgaccggtgctcgatttagtgtcgtcgcaagagagggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 447659 - DNA, 480 bp, Homo sapiens; identical to SEQ ID NO: 445011
  misc_feature: HEFZJCU01EFMSE.22.36.D03.1.454.heavy.3.raw

SEQ ID NO: 447660 - DNA, 313 bp, Homo sapiens; identical to SEQ ID NO: 444518
  misc_feature: HEFZJCU01CKQPU.7.10.A10.1.454.heavy.3.raw

SEQ ID NO: 447661 - DNA, 528 bp, Homo sapiens
  misc_feature: HEFZJCU01CII5V.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcgacagcggccctgggctgcctggtcaaggactacttccacg

SEQ ID NO: 447662 - DNA, 496 bp, Homo sapiens
  misc_feature: HEFZJCU01B95HF.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttaggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttccccctggcgccctgctccaggagcacctccgagagcacagcggccctggctgcctggtcaaggactacttccctacagtgct

SEQ ID NO: 447663 - DNA, 492 bp, Homo sapiens; identical to SEQ ID NO: 444827
  misc_feature: HEFZJCU01CFURW.4.28.C06.1.454.heavy.3.raw

SEQ ID NO: 447664 - DNA, 507 bp, Homo sapiens
  misc_feature: HEFZJCU01DWD9P.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggccaagggacactggtcaccgtctcttcagcctccaccaagggcccatcggtcttccccctggccgccctgctccaggacg

SEQ ID NO: 447665 - DNA, 390 bp, Homo sapiens; identical to SEQ ID NO: 444541
  misc_feature: HEFZJCU01CQVP8.16.24.C02.1.454.heavy.3.raw

SEQ ID NO: 447666 - DNA, 324 bp, Homo sapiens
  misc_feature: HEFZJCU01EPS90.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggtcctgggctgcctggtcaaggactacttcccatactcgta

SEQ ID NO: 447667 - DNA, 506 bp, Homo sapiens; identical to SEQ ID NO: 446520
  misc_feature: HEFZJCU01D1T53.10.38.D05.1.454.heavy.3.raw

SEQ ID NO: 447668 - DNA, 486 bp, Homo sapiens; identical to SEQ ID NO: 444861
  misc_feature: HEFZJCU01EYCH4.47.55.E11.1.454.heavy.3.raw

SEQ ID NO: 447669 - DNA, 375 bp, Homo sapiens; identical to SEQ ID NO: 445125
  misc_feature: HEFZJCU01DOXBW.9.53.E09.1.454.heavy.3.raw

SEQ ID NO: 447670 - DNA, 509 bp, Homo sapiens; identical to SEQ ID NO: 445824
  misc_feature: HEFZJCU01EO1F7.9.14.B03.1.454.heavy.3.raw

SEQ ID NO: 447671 - DNA, 509 bp, Homo sapiens
  misc_feature: HEFZJCU01EBMDC.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcacc

SEQ ID NO: 447672 - DNA, 503 bp, Homo sapiens
  misc_feature: HEFZJCU01AF6PB.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctggggcacagcggccctgggctgcctggtcaaggactacttcctacgtcgtat

SEQ ID NO: 447673 - DNA, 379 bp, Homo sapiens; identical to SEQ ID NO: 444450
  misc_feature: HEFZJCU01A73TC.47.77.G11.1.454.heavy.3.raw

SEQ ID NO: 447674 - DNA, 496 bp, Homo sapiens; identical to SEQ ID NO: 445094
  misc_feature: HEFZJCU01D4I31.10.71.G05.1.454.heavy.3.raw

SEQ ID NO: 447675 - DNA, 513 bp, Homo sapiens; identical to SEQ ID NO: 446452
  misc_feature: HEFZJCU01CL2CN.17.33.C11.1.454.heavy.3.raw

SEQ ID NO: 447676 - DNA, 469 bp, Homo sapiens
  misc_feature: HEFZJCU01DR8HK.49.10.A10.1.454.heavy.3.raw
agtcgagagacacgaccggtgctcgatttagcgtcgatctcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggccccccctttcaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 447677 - DNA, 482 bp, Homo sapiens; identical to SEQ ID NO: 444503
  misc_feature: HEFZJCU01EKMI1.7.10.A10.1.454.heavy.3.raw

SEQ ID NO: 447678 - DNA, 512 bp, Homo sapiens
  misc_feature: HEFZJCU01ELFF5.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcatctatgaccggggacacgtccatcgccacaacttacatggaactgaccagtctgacatttgacgacacggccgtctattactgtgcgacagaagcggcggacagaggttcgcttactggttcgaggctctccccacg

SEQ ID NO: 447679 - DNA, 504 bp, Homo sapiens; identical to SEQ ID NO: 446672
  misc_feature: HEFZJCU01DL72W.10.38.D05.1.454.heavy.3.raw

SEQ ID NO: 447680 - DNA, 511 bp, Homo sapiens
  misc_feature: HEFZJCU01DL8N2.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgtcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 447681 - DNA, 541 bp, Homo sapiens
  misc_feature: HEFZJCU01DX2K6.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactctggttcaatgagttattatgtcttttgactattgggcagggaaccctggtcaccgtctcctcagcctccaccaaggg

SEQ ID NO: 447682 - DNA, 393 bp, Homo sapiens; identical to SEQ ID NO: 444509
  misc_feature: HEFZJCU01C9NYY.49.46.E02.1.454.heavy.3.raw

SEQ ID NO: 447683 - DNA, 312 bp, Homo sapiens
  misc_feature: HEFZJCU01CVSOW.49.8.A08.1.454.heavy.3.raw
agtcgagagacacgaccggtgctcgatttagcatactctacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggttttccccctggcaccctcctccaagagcacctctggggcacagcggccctgggctgcctggtcaaggactacttcctctctcgact

SEQ ID NO: 447684 - DNA, 520 bp, Homo sapiens
  misc_feature: HEFZJCU01DKUAD.12.71.G05.1.454.heavy.3.raw
atacgacgtacacgaccggtgctcgatttagtgtcgtcgcaagagagaggggaagacggattggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctgcgccctgctccaggagcacctccgagagcacagcggccctgggctgcctggtcaaggactacttcctacg

SEQ ID NO: 447685 - DNA, 466 bp, Homo sapiens
  misc_feature: HEFZJCU01A7BCM.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcggccctgggctgcctggtcaaggactacttctatgtatact

SEQ ID NO: 447686 - DNA, 460 bp, Homo sapiens; identical to SEQ ID NO: 444688
  misc_feature: HEFZJCU01B7KFF.53.12.B01.1.454.heavy.3.raw

SEQ ID NO: 447687 - DNA, 513 bp, Homo sapiens; identical to SEQ ID NO: 446452
  misc_feature: HEFZJCU01BO5C6.17.33.C11.1.454.heavy.3.raw

SEQ ID NO: 447688 - DNA, 532 bp, Homo sapiens
  misc_feature: HEFZJCU01EM27G.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccgaaattgactactggggccgagggaaccctggtcaccgtctcctcagcctccaccaacgggcccactcggtcttccccctcggccgccctcgctccac

SEQ ID NO: 447689 - DNA, 440 bp, Homo sapiens
  misc_feature: HEFZJCU01EU65B.48.20.B09.1.454.heavy.3.raw
agtatacatacacgaccggtgctcgatttagtgtagtgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttccccctggcgccctgctccaggagcacctctgggggcacagcggccctgggctgcctggtcaaggactacttcctatgtatact

SEQ ID NO: 447690 - DNA, 462 bp, Homo sapiens
  misc_feature: HEFZJCU01AF0FW.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagagcacagcggccctgggctgcctggtcaaggactacttccacgagagta

SEQ ID NO: 447691 - DNA, 409 bp, Homo sapiens; identical to SEQ ID NO: 444519
  misc_feature: HEFZJCU01CDQPL.3.41.D08.1.454.heavy.3.raw

SEQ ID NO: 447692 - DNA, 480 bp, Homo sapiens; identical to SEQ ID NO: 445011
  misc_feature: HEFZJCU01BFQTB.22.36.D03.1.454.heavy.3.raw

SEQ ID NO: 447693 - DNA, 525 bp, Homo sapiens
  misc_feature: HEFZJCU01EMNHH.53.17.B06.1.454.heavy.3.raw
cgcgtatacacacgaccggtgctcgatttagtcgatagtgaagggggctctgggagaggagcccagcactagaagtcggcggtttttccattcggtgatcagcactgaacacagaggactcaccatggactgttaagaggtgtgtcgagcactgggtccgccaggctccaggcaaggggctgaagtgactgccacttaacatcagatgatcgaatcaataggttttatgcggactcggtgaggggccgattcaccgtctccggagacaattccaagaatacgagataggtgcaaatgaagaccctgggacttgaagacacgggtgcgtcttcctgtgcgactgtgtcccaacgttgtattctttgagtggacgtctcgagaacaagggaccacggtcatcgtctcctccgatgagactgaccactctggggcctttgatttccgccactgcctgtggaatttccgcactagtggagcctccaccaagggcccatcggtcttcccctggcaccctcctccaagacg

SEQ ID NO: 447694 - DNA, 403 bp, Homo sapiens; identical to SEQ ID NO: 445456
  misc_feature: HEFZJCU01ESWJF.3.72.G06.1.454.heavy.3.raw

SEQ ID NO: 447695 - DNA, 521 bp, Homo sapiens
  misc_feature: HEFZJCU01B24ZS.12.40.D07.1.454.heavy.3.raw
atacgacgtacacgaccggtgctcgatttagtgatagagcgtaacaacagagggctcaccatggagtttgggctgagcgtggtttcgtcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggaccaggggaccctggtcatcgtctccccagcctccaccaagggcccatcggtctccccctggcg

SEQ ID NO: 447696 - DNA, 324 bp, Homo sapiens; identical to SEQ ID NO: 444475
  misc_feature: HEFZJCU01DMUR1.18.17.B06.1.454.heavy.3.raw

SEQ ID NO: 447697 - DNA, 385 bp, Homo sapiens; identical to SEQ ID NO: 444438
  misc_feature: HEFZJCU01BL2N0.18.60.F05.1.454.heavy.3.raw

SEQ ID NO: 447698 - DNA, 393 bp, Homo sapiens; identical to SEQ ID NO: 444509
  misc_feature: HEFZJCU01B17MP.49.46.E02.1.454.heavy.3.raw

SEQ ID NO: 447699 - DNA, 482 bp, Homo sapiens; identical to SEQ ID NO: 444503
  misc_feature: HEFZJCU01CLWYV.7.10.A10.1.454.heavy.3.raw

SEQ ID NO: 447700 - DNA, 396 bp, Homo sapiens; identical to SEQ ID NO: 444469
  misc_feature: HEFZJCU01BI5FN.47.46.E02.1.454.heavy.3.raw

SEQ ID NO: 447701 - DNA, 500 bp, Homo sapiens
  misc_feature: HEFZJCU01ENVGH.52.6.A06.1.454.heavy.3.raw
cgcagtacgacacgaccggtgctcgatttagatctactgacaggggggggagacgagcccagcactggaagtcgccggtgtttccattcggtgatcatcactgaacacagaggactcaccatggagtttgggcagagctgggttctcctcgttgttcttttaagaggtgtccagtgtcaggctccaggcaagggactggagtgggtggcagttatatcagctgatggaggcaataagtattacgcagattctgcgaggggccgattcaccatatccagagacaactcccaagatatgatatatctgcaaatgaacagcctgagacctgaggacacggccatatattattgtgcgtcagggggcagtgcctggccacgtgatgcttttgatttctggggccaagggacattcgtcaccgtctcctcagcctccaccaagggcccatcggtcttcccctggcaccctcctccaagagcacctctgggggcacagcggccctc

SEQ ID NO: 447702 - DNA, 527 bp, Homo sapiens; identical to SEQ ID NO: 446775
  misc_feature: HEFZJCU01BE067.9.78.H01.1.454.heavy.3.raw

SEQ ID NO: 447703 - DNA, 483 bp, Homo sapiens; identical to SEQ ID NO: 444639
  misc_feature: HEFZJCU01A90N3.11.23.C01.1.454.heavy.3.raw

SEQ ID NO: 447704 - DNA, 504 bp, Homo sapiens
  misc_feature: HEFZJCU01C3SZ0.49.38.D05.1.454.heavy.3.raw
agtcgagagacacgaccggtgctcgatttagtatctgatagttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagcacctctggggcacagcggccctgggctgcctggtcaaggactactcctctctcg

SEQ ID NO: 447705 - DNA, 519 bp, Homo sapiens; identical to SEQ ID NO: 446650
  misc_feature: HEFZJCU01CDM3T.13.76.G10.1.454.heavy.3.raw

SEQ ID NO: 447706 - DNA, 499 bp, Homo sapiens
  misc_feature: HEFZJCU01ENCGM.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttggggtggttc

SEQ ID NO: 447707 - DNA, 489 bp, Homo sapiens
  misc_feature: HEFZJCU01BMOS6.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcac

SEQ ID NO: 447708 - DNA, 488 bp, Homo sapiens
  misc_feature: HEFZJCU01EJNWU.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgccctgctccaggagcacctccgagagcacagcggccctgggctgcctggtcaaggactacttcctacgtgagct

SEQ ID NO: 447709 - DNA, 369 bp, Homo sapiens
  misc_feature: HEFZJCU01DD0PH.14.77.G11.1.454.heavy.3.raw
cgtctagtaccacgaccggtgctcgatttagctagtcactcaagggaaagggactggagtgggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaaccctggtcaccgtctcctcagcctccaccaagggcccatcggtcttccccctggcaccctcctccaagagcacctctggggcacagcggccctgggctgcctggtcaaggactacttccgtactagacg

SEQ ID NO: 447710 - DNA, 465 bp, Homo sapiens
  misc_feature: HEFZJCU01EVB9W.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttccccctggccgccctgctccaggagcacctccgagagcacagcggccctgggctgcctggtcaaggactacttcccacgagagta

SEQ ID NO: 447711 - DNA, 497 bp, Homo sapiens
  misc_feature: HEFZJCU01D5EGU.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 447712 - DNA, 432 bp, Homo sapiens; identical to SEQ ID NO: 444920
  misc_feature: HEFZJCU01DYGQ7.11.39.D06.1.454.heavy.3.raw

SEQ ID NO: 447713 - DNA, 511 bp, Homo sapiens
  misc_feature: HEFZJCU01CN6NB.4.67.G01.1.454.heavy.3.raw
  modified_base (489)..(489): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcggtgcgttttctaggtcggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagattcncgggctggttccgcggtccggg

SEQ ID NO: 447714 - DNA, 482 bp, Homo sapiens; identical to SEQ ID NO: 444503
  misc_feature: HEFZJCU01BTVR9.7.10.A10.1.454.heavy.3.raw

SEQ ID NO: 447715 - DNA, 509 bp, Homo sapiens
  misc_feature: HEFZJCU01E1A93.22.86.H09.1.454.heavy.3.raw
acatacgcgtcacgaccggtgctcgatttagtgctatagacttgggtttgggctgagcgtgggttttcctcgttagctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaaggggacactggtcaccgtctcttcagcctccaccaagggcccatcggtcttcccctggcgccctgctccaggacg

SEQ ID NO: 447716 - DNA, 516 bp, Homo sapiens
  misc_feature: HEFZJCU01B0MOH.51.58.F03.1.454.heavy.3.raw
cgatcgtatacacgaccggtgctcgatttagtctgatcgagaagggaaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactaccttgaaaactggggccacggaaccctggtcaccgtctcctcagcctccaccaagggcccatcggt

SEQ ID NO: 447717 - DNA, 389 bp, Homo sapiens
  misc_feature: HEFZJCU01CZXTL.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactactccgagtagtaca

SEQ ID NO: 447718 - DNA, 503 bp, Homo sapiens; identical to SEQ ID NO: 445995
  misc_feature: HEFZJCU01EZAOS.17.25.C03.1.454.heavy.3.raw

SEQ ID NO: 447719 - DNA, 501 bp, Homo sapiens
  misc_feature: HEFZJCU01CREG7.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctc

SEQ ID NO: 447720 - DNA, 501 bp, Homo sapiens
  misc_feature: HEFZJCU01BWBXJ.19.86.H09.1.454.heavy.3.raw
tactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaagggcataaagtggttcgacccc

SEQ ID NO: 447721 - DNA, 512 bp, Homo sapiens
  misc_feature: HEFZJCU01ADM4K.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaagggccc

SEQ ID NO: 447722 - DNA, 510 bp, Homo sapiens
  misc_feature: HEFZJCU01BFKMY.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggagcacctctgggggcacacgcggccctgggctgcctggtcaaggactactcccata

SEQ ID NO: 447723 - DNA, 514 bp, Homo sapiens
  misc_feature: HEFZJCU01C5GI4.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctattttaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgt

SEQ ID NO: 447724 - DNA, 519 bp, Homo sapiens; identical to SEQ ID NO: 446650
  misc_feature: HEFZJCU01BV5P0.13.76.G10.1.454.heavy.3.raw

SEQ ID NO: 447725 - DNA, 526 bp, Homo sapiens
  misc_feature: HEFZJCU01D7NGM.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacgggttttggggcggcggactcctcttgagatcgtgggccgagggacaagtggtcaccgtctcttcacgt

SEQ ID NO: 447726 - DNA, 501 bp, Homo sapiens
  misc_feature: HEFZJCU01B1JQU.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttccctacgtcgtat

SEQ ID NO: 447727 - DNA, 480 bp, Homo sapiens; identical to SEQ ID NO: 445011
  misc_feature: HEFZJCU01EJBPS.22.36.D03.1.454.heavy.3.raw

SEQ ID NO: 447728 - DNA, 500 bp, Homo sapiens; identical to SEQ ID NO: 445080
  misc_feature: HEFZJCU01DY9OK.3.81.H04.1.454.heavy.3.raw

SEQ ID NO: 447729 - DNA, 379 bp, Homo sapiens; identical to SEQ ID NO: 444450
  misc_feature: HEFZJCU01A0XAQ.47.77.G11.1.454.heavy.3.raw

SEQ ID NO: 447730 - DNA, 498 bp, Homo sapiens
  misc_feature: HEFZJCU01EC06S.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagccggccctgggctgcctggtcaaggactacttccagtcgctaga

SEQ ID NO: 447731 - DNA, 533 bp, Homo sapiens
  misc_feature: HEFZJCU01CKA77.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgtttattggggccagggagcctggtctaccg

SEQ ID NO: 447732 - DNA, 512 bp, Homo sapiens
  misc_feature: HEFZJCU01CXEMC.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggcccatcggtcttcccctggc

SEQ ID NO: 447733 - DNA, 481 bp, Homo sapiens
  misc_feature: HEFZJCU01D662Q.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggcctgggctgcctggtcaaggactacttccgtatctctcg

SEQ ID NO: 447734 - DNA, 385 bp, Homo sapiens
  misc_feature: HEFZJCU01BV51D.21.2.A02.1.454.heavy.3.raw
tcgtcgctcgcacgaccggtgctcgatttagactcatctaccagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacga

SEQ ID NO: 447735 - DNA, 515 bp, Homo sapiens
  misc_feature: HEFZJCU01AIGVU.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgaccctggggccagggaacccttgtcaccgtctcctcagcctccaccaagggccc

SEQ ID NO: 447736 - DNA, 531 bp, Homo sapiens
  misc_feature: HEFZJCU01BTC2Y.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaaggtaatagaaagtatgcgacgccgtgaagggccggattcaccatctccagagacaattccaacaaacatgttgtatctgcaaatgaatagcctgagagccgaggacacggctgtgtattactgtgtcagagatggagggggtggtgatccaggtatgattgtgtactactaccacggtctggacgtctggggccaagggaccgacggtcaccgtctcctcagcctccaccaaggcccgatcggtcttcccctcggcaccctcctccaagagcacctctggggggcacagcggccctgggctgcctggtcaaggactacttccg

SEQ ID NO: 447737 - DNA, 391 bp, Homo sapiens; identical to SEQ ID NO: 444994
  misc_feature: HEFZJCU01EV88A.40.58.F03.1.454.heavy.3.raw

SEQ ID NO: 447738 - DNA, 501 bp, Homo sapiens; identical to SEQ ID NO: 445341
  misc_feature: HEFZJCU01BECOQ.48.34.D01.1.454.heavy.3.raw

SEQ ID NO: 447739 - DNA, 502 bp, Homo sapiens
  misc_feature: HEFZJCU01B20S2.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtgtccttacaatgaccaatatggaccctgtggacacagccacatattactgttcacgctctatggttcggggagttattagtccctactttgactactggggccagggaactctggtcacgtctccgcagcctcacc

SEQ ID NO: 447740 - DNA, 521 bp, Homo sapiens
  misc_feature: HEFZJCU01C4KQC.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagagcacctctgggggcacagcggccctgggctgcctggtcaaggactacttccagacgtatca

SEQ ID NO: 447741 - DNA, 528 bp, Homo sapiens
  misc_feature: HEFZJCU01BZSGA.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctcccttgacttctggggccatggaaccccggtccg

SEQ ID NO: 447742 - DNA, 500 bp, Homo sapiens; identical to SEQ ID NO: 445720
  misc_feature: HEFZJCU01CXD39.3.20.B09.1.454.heavy.3.raw

SEQ ID NO: 447743 - DNA, 493 bp, Homo sapiens
  misc_feature: HEFZJCU01DAD0K.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagaactcactgtatctgcaaatgaacagcctgagagccgaggacacggcagtttattactgtgcgagagagtggct

SEQ ID NO: 447744 - DNA, 512 bp, Homo sapiens
  misc_feature: HEFZJCU01C1LWN.21.34.D01.1.454.heavy.3.raw
tcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaaagtatgtggactctgtgaagggccgattcaccatcttcagagacaacgccaagaactcactttatctgcaaatgaatagcctgagagtcgaagacacggctgtgtattactgtgcgagagatagcgaggaggtggagcagctcgtcgatttgtactacatggacgtctggggcaaagggaccacggtcaccgtctcctcagcctccaccaagggcccatcggtcttcccctggcaccctcctccaagagcacctctgggggcacagcggccctgggctgcctggtcaaggactacttcccgagcgacga

SEQ ID NO: 447745 - DNA, 379 bp, Homo sapiens; identical to SEQ ID NO: 444450
  misc_feature: HEFZJCU01C0N73.47.77.G11.1.454.heavy.3.raw

SEQ ID NO: 447746 - DNA, 500 bp, Homo sapiens
  misc_feature: HEFZJCU01AKXLX.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggta

SEQ ID NO: 447747 - DNA, 503 bp, Homo sapiens; identical to SEQ ID NO: 446295
  misc_feature: HEFZJCU01DU26X.10.35.D02.1.454.heavy.3.raw

SEQ ID NO: 447748 - DNA, 392 bp, Homo sapiens
  misc_feature: HEFZJCU01DVVOL.5.70.G04.1.454.heavy.3.raw
atcagacacgcacgaccggtgctcgatttagtgtagtgtgaagggaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactggggcctgggaaccctggtcaccgtctcctcagcctccaccaagggcccatcggtcttccccctggcaccctcctccaagagcacctctgggggcacagcggccctgggctgcctggtcaaggactacttcccgtgtctgat

SEQ ID NO: 447749 - DNA, 517 bp, Homo sapiens; identical to SEQ ID NO: 445913
  misc_feature: HEFZJCU01DWOCH.7.78.H01.1.454.heavy.3.raw

SEQ ID NO: 447750 - DNA, 517 bp, Homo sapiens; identical to SEQ ID NO: 446891
  misc_feature: HEFZJCU01BLWOF.17.33.C11.1.454.heavy.3.raw

SEQ ID NO: 447751 - DNA, 507 bp, Homo sapiens
  misc_feature: HEFZJCU01CWE41.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggccatcggtcttcccctggcaccctcctccaagagcacctctgggggcacagcggccctgggcgtgcctggtcaaggactactccgagtgcgtct

SEQ ID NO: 447752 - DNA, 390 bp, Homo sapiens; identical to SEQ ID NO: 445211
  misc_feature: HEFZJCU01C11VQ.13.42.D09.1.454.heavy.3.raw

SEQ ID NO: 447753 - DNA, 525 bp, Homo sapiens
  misc_feature: HEFZJCU01CU67M.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtcatcgtct

SEQ ID NO: 447754 - DNA, 445 bp, Homo sapiens; identical to SEQ ID NO: 445213
  misc_feature: HEFZJCU01DNXKF.3.86.H09.1.454.heavy.3.raw

SEQ ID NO: 447755 - DNA, 506 bp, Homo sapiens
  misc_feature: HEFZJCU01EVMO2.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatacactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 447756 - DNA, 490 bp, Homo sapiens
  misc_feature: HEFZJCU01EUKJH.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgcctgctccaggagcacctccgagagcacagcggccctgggctgcctggtcaaggactacttcccacgagagta

SEQ ID NO: 447757 - DNA, 518 bp, Homo sapiens; identical to SEQ ID NO: 444718
  misc_feature: HEFZJCU01COOX9.9.34.D01.1.454.heavy.3.raw

SEQ ID NO: 447758 - DNA, 508 bp, Homo sapiens
  misc_feature: HEFZJCU01B14DN.49.57.F02.1.454.heavy.3.raw
agtcgagagacacgaccggtgctcgatttagctcgatatagttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagcacctctgggggcacagcggccctgggctgcctggtcaaggactacttcctctctcgta

SEQ ID NO: 447759 - DNA, 396 bp, Homo sapiens; identical to SEQ ID NO: 444731
  misc_feature: HEFZJCU01A5NSZ.18.61.F06.1.454.heavy.3.raw

SEQ ID NO: 447760 - DNA, 489 bp, Homo sapiens; identical to SEQ ID NO: 444591
  misc_feature: HEFZJCU01CEI3G.18.70.G04.1.454.heavy.3.raw

SEQ ID NO: 447761 - DNA, 394 bp, Homo sapiens; identical to SEQ ID NO: 446347
  misc_feature: HEFZJCU01C0GJ6.52.41.D08.1.454.heavy.3.raw

SEQ ID NO: 447762 - DNA, 510 bp, Homo sapiens
  misc_feature: HEFZJCU01A521D.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctccgagagcacagcggccctgggctgcctggtcaaggactacttcccta

SEQ ID NO: 447763 - DNA, 499 bp, Homo sapiens
  misc_feature: HEFZJCU01CJSPO.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctatgcttttgatatctggggccaagggac

SEQ ID NO: 447764 - DNA, 523 bp, Homo sapiens
  misc_feature: HEFZJCU01BBPJ3.52.87.H10.1.454.heavy.3.raw
cgcagtacgacacgaccggtgctcgatttagcagtactgcgttgggtttgggggggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaaccc

SEQ ID NO: 447765 - DNA, 335 bp, Homo sapiens
  misc_feature: HEFZJCU01AIDZI.7.10.A10.1.454.heavy.3.raw
cgtgtctctacacgaccggtgctcgatttagcgtcgatctcaggggtccgggagatcatgagggtgtccttgggttttgggggaagaggaagactgacggtccccccaggagttcaggtgctgggccgtgtattactgtgtgagagataagtccgggtatcacttggatagaagtgcttattacattgactactgggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 447766 - DNA, 397 bp, Homo sapiens
  misc_feature: HEFZJCU01ANZM0.49.77.G11.1.454.heavy.3.raw
agtcgagagacacgaccggtgctcgatttagctagtcactcaagggaaagggcttgagtggattgggagtatatattttactgggacgtcctactacaacccgtccctcaagagtcgagtcaccatatcagaagacacatccaagaaccaattctccttgaagctgacctctgtgaccgccgcggacaccggccgtgtattactgtggagttccagctgtcggatactactactactacggtgtggacgtcgtggggccaagggaccacggtcaccgtctcctcagcctccaccaagggcccatcggtccttccccctggccgccctgctccaggagcacctccgagagcacagcggccctgggctgcctggtcaaggactacttcctctctcgact

SEQ ID NO: 447767 - DNA, 526 bp, Homo sapiens
  misc_feature: HEFZJCU01EZZPA.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggccctgggccg

SEQ ID NO: 447768 - DNA, 506 bp, Homo sapiens
  misc_feature: HEFZJCU01DL1XZ.52.19.B08.1.454.heavy.3.raw
cgcagtacgacacgaccggtgctcgatttagtgagtcagtaagggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctgggccaagggaccacggtcatcgtctcctcagcctccaccaagggcccatccggtcttccccctggccaccctcctccaagagcacctctgggggcacagcggccctgggcctgcctggtcg

SEQ ID NO: 447769 - DNA, 491 bp, Homo sapiens
  misc_feature: HEFZJCU01DSSMP.40.55.E11.1.454.heavy.3.raw
tctagcgactcacgaccggtgctcgatttagcactcgcacgttgggtttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggcaggacat

SEQ ID NO: 447770 - DNA, 435 bp, Homo sapiens
  misc_feature: HEFZJCU01EX2AK.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 447771 - DNA, 374 bp, Homo sapiens; identical to SEQ ID NO: 444640
  misc_feature: HEFZJCU01EXKUR.7.37.D04.1.454.heavy.3.raw

SEQ ID NO: 447772 - DNA, 506 bp, Homo sapiens; identical to SEQ ID NO: 444696
  misc_feature: HEFZJCU01BANAQ.16.34.D01.1.454.heavy.3.raw

SEQ ID NO: 447773 - DNA, 482 bp, Homo sapiens; identical to SEQ ID NO: 445484
  misc_feature: HEFZJCU01BH74E.2.33.C11.1.454.heavy.3.raw

SEQ ID NO: 447774 - DNA, 545 bp, Homo sapiens
  misc_feature: HEFZJCU01ET0SZ.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggaccttcggcccttgggggagttatcgttactttgacttactgggggccaggggaacccaggtcaccggtctcccg

SEQ ID NO: 447775 - DNA, 500 bp, Homo sapiens
  misc_feature: HEFZJCU01BHKZR.10.34.D01.1.454.heavy.3.raw
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgtt

SEQ ID NO: 447776 - DNA, 518 bp, Homo sapiens; identical to SEQ ID NO: 445423
  misc_feature: HEFZJCU01DGMBF.7.78.H01.1.454.heavy.3.raw

SEQ ID NO: 447777 - DNA, 454 bp, Homo sapiens
  misc_feature: HEFZJCU01AUYAL.40.35.D02.1.454.heavy.3.raw
tctagcgactcacgaccggtgctcgatttagcacacgatagttgggtttgggattcacgttgcagatgtagggctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 447778 - DNA, 508 bp, Homo sapiens
  misc_feature: HEFZJCU01B89PG.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagcgtggtttcgtgtaggctctttaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaacccg

SEQ ID NO: 447779 - DNA, 496 bp, Homo sapiens; identical to SEQ ID NO: 444697
  misc_feature: HEFZJCU01DW2A8.16.37.D04.1.454.heavy.3.raw

SEQ ID NO: 447780 - DNA, 503 bp, Homo sapiens
  misc_feature: HEFZJCU01CPQDK.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctcccgagagcacagcggccctgggctgcctggtcaaggactacttcccgagcgacga

SEQ ID NO: 447781 - DNA, 497 bp, Homo sapiens; identical to SEQ ID NO: 445179
  misc_feature: HEFZJCU01BX9GN.12.55.E11.1.454.heavy.3.raw

SEQ ID NO: 447782 - DNA, 504 bp, Homo sapiens; identical to SEQ ID NO: 447065
  misc_feature: HEFZJCU01EBOYJ.10.23.C01.1.454.heavy.3.raw

SEQ ID NO: 447783 - DNA, 430 bp, Homo sapiens; identical to SEQ ID NO: 444675
  misc_feature: HEFZJCU01A3GQV.40.34.D01.1.454.heavy.3.raw

SEQ ID NO: 447784 - DNA, 411 bp, Homo sapiens; identical to SEQ ID NO: 445580
  misc_feature: HEFZJCU01EZ9E3.51.31.C09.1.454.heavy.3.raw

SEQ ID NO: 447785 - DNA, 495 bp, Homo sapiens
  misc_feature: HEFZJCU01EZN0B.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggccagggaaccctagtcaccgtctcctcagcctccaccaagggcccatcggtcttcccctggcgccctgctccaggacgcacct

SEQ ID NO: 447786 - DNA, 520 bp, Homo sapiens
  misc_feature: HEFZJCU01BMT2E.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaactatgcggactctgtgaagggccgattcaccatttccagagacaacgccaagaagtcactctctctacacatgaccagcctgacagccgaggacacggctgtttattactgtgcgagagatggcactcggggcggtgactttgactactggggccagggcaccctggtcaccgtctcctcagcctccaccaagggcccatcggtcttcccctggccgccctgcaggagc

SEQ ID NO: 447787 - DNA, 397 bp, Homo sapiens
  misc_feature: HEFZJCU01AWEYW.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagtcggccctgggctgcctggtcaaggactacttcctacgtgagct

SEQ ID NO: 447788 - DNA, 426 bp, Homo sapiens
  misc_feature: HEFZJCU01BTCCM.49.15.B04.1.454.heavy.3.raw
agtcgagagacacgaccggtgctcgatttagacagtatatatccgcgggcacgaccggtgctcgatttagatcgtctgtgttgggtttgggatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 447789 - DNA, 517 bp, Homo sapiens; identical to SEQ ID NO: 447179
  misc_feature: HEFZJCU01BPQL2.52.78.H01.1.454.heavy.3.raw

SEQ ID NO: 447790 - DNA, 494 bp, Homo sapiens
  misc_feature: HEFZJCU01BZOVM.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctggggcacagcggccctgggctgcctggtcaggactacttccgagtagtaca

SEQ ID NO: 447791 - DNA, 395 bp, Homo sapiens; identical to SEQ ID NO: 444494
  misc_feature: HEFZJCU01COIAZ.47.46.E02.1.454.heavy.3.raw

SEQ ID NO: 447792 - DNA, 499 bp, Homo sapiens
  misc_feature: HEFZJCU01B97R2.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttc

SEQ ID NO: 447793 - DNA, 396 bp, Homo sapiens; identical to SEQ ID NO: 444426
  misc_feature: HEFZJCU01AJFR5.18.31.C09.1.454.heavy.3.raw

SEQ ID NO: 447794 - DNA, 464 bp, Homo sapiens; identical to SEQ ID NO: 444693
  misc_feature: HEFZJCU01A109P.9.30.C08.1.454.heavy.3.raw

SEQ ID NO: 447795 - DNA, 477 bp, Homo sapiens; identical to SEQ ID NO: 444659
  misc_feature: HEFZJCU01B9LNZ.16.10.A10.1.454.heavy.3.raw

SEQ ID NO: 447796 - DNA, 509 bp, Homo sapiens; identical to SEQ ID NO: 444586
  misc_feature: HEFZJCU01C4QT8.12.78.H01.1.454.heavy.3.raw

SEQ ID NO: 447797 - DNA, 376 bp, Homo sapiens
  misc_feature: HEFZJCU01BQA21.49.72.G06.1.454.heavy.3.raw
agtcgagagacacgaccggtgctcgatttagctacgactgcaagggaaaggggctggagtgggtggccaacataaaccaagatggaactgtggaagactacatagactctgtgaagggccgattcaccatctccagagacagcgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 447798 - DNA, 522 bp, Homo sapiens
  misc_feature: HEFZJCU01C9Z81.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtcttcccctggcg

SEQ ID NO: 447799 - DNA, 511 bp, Homo sapiens; identical to SEQ ID NO: 445268
  misc_feature: HEFZJCU01D5UFE.48.34.D01.1.454.heavy.3.raw

SEQ ID NO: 447800 - DNA, 385 bp, Homo sapiens; identical to SEQ ID NO: 444438
  misc_feature: HEFZJCU01C1ZS2.18.60.F05.1.454.heavy.3.raw

SEQ ID NO: 447801 - DNA, 488 bp, Homo sapiens
  misc_feature: HEFZJCU01EAHYM.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttccccctggcaccctcctccaagagcacctctgggggcacagcggccctgggctgcctggtcaggactacttcctacgtcgtat

SEQ ID NO: 447802 - DNA, 521 bp, Homo sapiens
  misc_feature: HEFZJCU01CT1YX.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatccggtcttccccctggccaccctcctccaagagcacctctgggggcacac

SEQ ID NO: 447803 - DNA, 497 bp, Homo sapiens
  misc_feature: HEFZJCU01ER9GU.22.78.H01.1.454.heavy.3.raw
acatacgcgtcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctgggggcacagcggccctgggctgcctggtcaaggactacttccagacgtatca

SEQ ID NO: 447804 - DNA, 504 bp, Homo sapiens
  misc_feature: HEFZJCU01D7GW0.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttcgtggggccagggaaccctggtccaccgtctcctcagcctccaccaagggcccatcggtcttcccctggcgccctgctccaggagcacctccgagagcacagccggcctgggctgcctggtcaaggactactccagacgtatca

SEQ ID NO: 447805 - DNA, 512 bp, Homo sapiens
  misc_feature: HEFZJCU01DQLOM.48.22.B11.1.454.heavy.3.raw
agtatacatacacgaccggtgctcgatttagacgacagctcaggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctagaaaaccgaggacacggccattttattttgtagctagatctgaagaattaccagctgctgtgttc

SEQ ID NO: 447806 - DNA, 500 bp, Homo sapiens
  misc_feature: HEFZJCU01CK2VS.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctggctgcctggtcaaggactacttcctatgtatact

SEQ ID NO: 447807 - DNA, 506 bp, Homo sapiens
  misc_feature: HEFZJCU01AI9X2.14.25.C03.1.454.heavy.3.raw
  modified_base (60)..(60): a, c, t, g, unknown or other
cgtctagtaccacgaccggtgctcgatttagtagtgtagatttgggtttgggctgagcgnggtttcgtcgtaggctctttaagtaggtgtcagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctc

SEQ ID NO: 447808 - DNA, 509 bp, Homo sapiens
  misc_feature: HEFZJCU01D0A4Y.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctgggggcacagcggccctgggctgcctggtcaaggactacttccgtacta

SEQ ID NO: 447809 - DNA, 482 bp, Homo sapiens
  misc_feature: HEFZJCU01BKZWZ.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcatctctgggggcacagcggccctgggctgcctggtcaaggactacttcctagagacacg

SEQ ID NO: 447810 - DNA, 500 bp, Homo sapiens; identical to SEQ ID NO: 445720
  misc_feature: HEFZJCU01CT1SL.3.20.B09.1.454.heavy.3.raw

SEQ ID NO: 447811 - DNA, 480 bp, Homo sapiens; identical to SEQ ID NO: 445011
  misc_feature: HEFZJCU01BPN9I.22.36.D03.1.454.heavy.3.raw

SEQ ID NO: 447812 - DNA, 490 bp, Homo sapiens
  misc_feature: HEFZJCU01DIMXO.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggccaccctcctccaagagcacctctgggggcacagcggcctgggctgcctggtcaggactacttccgagtgcgtct

SEQ ID NO: 447813 - DNA, 517 bp, Homo sapiens
  misc_feature: HEFZJCU01CGO5T.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaa

SEQ ID NO: 447814 - DNA, 490 bp, Homo sapiens
  misc_feature: HEFZJCU01EBWZ1.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccatcggtcttcccctggcgccctgctccaggagcacctccgagagcacagcggccctgggctgcctggtcaaggactacttccgtatctctcg

SEQ ID NO: 447815 - DNA, 380 bp, Homo sapiens
  misc_feature: HEFZJCU01B9TVH.3.70.G04.1.454.heavy.3.raw
agacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgccctgctccaggagcacctccgagagcacagcggccctgggctgcctggtcaggactacttccgagtgcgtct

SEQ ID NO: 447816 - DNA, 504 bp, Homo sapiens
  misc_feature: HEFZJCU01DLJIM.48.64.F09.1.454.heavy.3.raw
agtatacatacacgaccggtgctcgatttagcgcgtatacaaggggaggcttggtccagcctggggggtccctgaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgcctgctccaggagcacctccgagagcacagcggccctgggctgcctggtcaaggactacttcctatgtatact

SEQ ID NO: 447817 - DNA, 497 bp, Homo sapiens
  misc_feature: HEFZJCU01C2VK9.2.86.H09.1.454.heavy.3.raw
acgctcgacacacgaccggtgctcgatttagtgctatagacttgggtttgggggaggcttggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacataggggccggcgcgggagcgaatgacttctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 447818 - DNA, 312 bp, Homo sapiens
  misc_feature: HEFZJCU01DIO81.49.2.A02.1.454.heavy.3.raw
agtcgagagacacgaccggtgctcgatttagactcatctacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctggggcacagcggccctgggctgcctggtcaaggactacttcctctctcgact

SEQ ID NO: 447819 - DNA, 519 bp, Homo sapiens
  misc_feature: HEFZJCU01BLQNP.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcgcagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 447820 - DNA, 382 bp, Homo sapiens
  misc_feature: HEFZJCU01EVXNW.49.53.E09.1.454.heavy.3.raw
agtcgagagacacgaccggtgctcgatttagagagagtgtgttgggtttggggtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactacttcctctctcgact

SEQ ID NO: 447821 - DNA, 530 bp, Homo sapiens
  misc_feature: HEFZJCU01DMA5D.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccggtcttccccctggccgccctcg

SEQ ID NO: 447822 - DNA, 400 bp, Homo sapiens; identical to SEQ ID NO: 444452
  misc_feature: HEFZJCU01DDZI4.47.24.C02.1.454.heavy.3.raw

SEQ ID NO: 447823 - DNA, 495 bp, Homo sapiens
  misc_feature: HEFZJCU01C89AR.51.59.F04.1.454.heavy.3.raw
cgatcgtatacacgaccggtgctcgatttagtacacacacttagggattgggggagacgagcccagcactggaagtcgccggtgtttccattcggtgatcatcactgaacacagaggactcaccatggagtttgggctgagcggtggtttcgcgtaggcgctttaagtaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttttactgtgcgagaggggaatcgattacagcag

SEQ ID NO: 447824 - DNA, 394 bp, Homo sapiens
  misc_feature: HEFZJCU01AY1MQ.47.59.F04.1.454.heavy.3.raw
agctcacgtacacgaccggtgctcgatttagtacacacacttagggaggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaggataatgggggctcaaaccaaatttttcactactggggccagggatccctggtcgccgtcggctcagcctccaccaagggcccatcggtcttccccctggcgccctactccaggagcacctccgagagcacagcggccctgggctgcctggtcaaggactacttcctacgtgagct

SEQ ID NO: 447825 - DNA, 510 bp, Homo sapiens
  misc_feature: HEFZJCU01CQMW1.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctgggggccaggggaaccctggtcaccgtctcctcagcttccaccaaggcccatcggtcttcccctggcgtcccg

SEQ ID NO: 447826 - DNA, 396 bp, Homo sapiens; identical to SEQ ID NO: 444469
  misc_feature: HEFZJCU01CIWAF.47.46.E02.1.454.heavy.3.raw

SEQ ID NO: 447827 - DNA, 396 bp, Homo sapiens
  misc_feature: HEFZJCU01DHLCM.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacatcggccctgggctgcctggtcaaggactacttcctacgtgagct

SEQ ID NO: 447828 - DNA, 528 bp, Homo sapiens
  misc_feature: HEFZJCU01DX0RA.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccg

SEQ ID NO: 447829 - DNA, 324 bp, Homo sapiens; identical to SEQ ID NO: 444475
  misc_feature: HEFZJCU01A1RXJ.18.17.B06.1.454.heavy.3.raw

SEQ ID NO: 447830 - DNA, 500 bp, Homo sapiens; identical to SEQ ID NO: 444529
  misc_feature: HEFZJCU01CV8B1.12.38.D05.1.454.heavy.3.raw

SEQ ID NO: 447831 - DNA, 464 bp, Homo sapiens; identical to SEQ ID NO: 445062
  misc_feature: HEFZJCU01EU9UJ.19.10.A10.1.454.heavy.3.raw

SEQ ID NO: 447832 - DNA, 482 bp, Homo sapiens
  misc_feature: HEFZJCU01D6V9D.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggattacttcctagagacacg

SEQ ID NO: 447833 - DNA, 516 bp, Homo sapiens
  misc_feature: HEFZJCU01BU4TM.19.26.C04.1.454.heavy.3.raw
tactctcgtgcacgaccggtgctcgatttagtctagcgactttgggtttgggctgagcgtgggttttccgtcgttaggctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaaggggaccacgggtcatcgtctcccagcctccaccaagggcccatcggtcttcccctggcgccctgctccaggagca

SEQ ID NO: 447834 - DNA, 515 bp, Homo sapiens
  misc_feature: HEFZJCU01BGNMT.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggcaccctcctccaagagcacctctgggggcacagcggcccg

SEQ ID NO: 447835 - DNA, 501 bp, Homo sapiens; identical to SEQ ID NO: 447123
  misc_feature: HEFZJCU01B03C5.3.20.B09.1.454.heavy.3.raw

SEQ ID NO: 447836 - DNA, 522 bp, Homo sapiens
  misc_feature: HEFZJCU01ALZYD.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctcccgagagcacagcggccctgggctgcctggtcaaggactacttcctacg

SEQ ID NO: 447837 - DNA, 509 bp, Homo sapiens
  misc_feature: HEFZJCU01B2EJ6.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactgggccagggcaccctggtcaccgtctcctcagcttccaccaagggcccatcggtcttcccctggcgccctgctccaggagcacctctgggggcacagcggccctgggctgcctggtcaaggactactcccatac

SEQ ID NO: 447838 - DNA, 517 bp, Homo sapiens
  misc_feature: HEFZJCU01EUUXF.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctcggcaccctcctccaagagcacctctgggggcacagcggccctgggctgcctggtcaaggactaccctagagacacg

SEQ ID NO: 447839 - DNA, 479 bp, Homo sapiens; identical to SEQ ID NO: 447128
  misc_feature: HEFZJCU01CJSBF.4.37.D04.1.454.heavy.3.raw

SEQ ID NO: 447840 - DNA, 483 bp, Homo sapiens
  misc_feature: HEFZJCU01C9Q0R.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggtcctgggctgcctggtcaaggactacttcccactactatg

SEQ ID NO: 447841 - DNA, 480 bp, Homo sapiens; identical to SEQ ID NO: 445011
  misc_feature: HEFZJCU01EIT2A.22.36.D03.1.454.heavy.3.raw

SEQ ID NO: 447842 - DNA, 397 bp, Homo sapiens
  misc_feature: HEFZJCU01EP90L.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcgggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 447843 - DNA, 372 bp, Homo sapiens; identical to SEQ ID NO: 444727
  misc_feature: HEFZJCU01CNOJH.3.42.D09.1.454.heavy.3.raw

SEQ ID NO: 447844 - DNA, 490 bp, Homo sapiens
  misc_feature: HEFZJCU01BFNC8.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggac

SEQ ID NO: 447845 - DNA, 385 bp, Homo sapiens
  misc_feature: HEFZJCU01EWGJJ.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggactactttccatactcgta

SEQ ID NO: 447846 - DNA, 472 bp, Homo sapiens
  misc_feature: HEFZJCU01AUBY9.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactggggggcctgtcgtggtggttggtgccgcaatgatgcatttcatatttggggccaagggacagtggtcaccgtctcggcagcctccaccaagggcccatcggtcttccccctggcgccctgctccaggagcacctccgagagcacagcggccctgggctgcctggtcaaggactacttccacgcgtatgt

SEQ ID NO: 447847 - DNA, 522 bp, Homo sapiens
  misc_feature: HEFZJCU01CFYIH.52.71.G05.1.454.heavy.3.raw
cgcagtacgacacgaccggtgctcgatttagtgtcgtcgcaagagagaggagcccagccctgggattttcaggtgttttcatttggtgatcaggactgaacagagagaaatcaccatggagtttgggctgagcgtggcgttttcttaggtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatgggcccattgactactggggccaggggaaccc

SEQ ID NO: 447848 - DNA, 316 bp, Homo sapiens; identical to SEQ ID NO: 444444
  misc_feature: HEFZJCU01BUMT5.47.56.F01.1.454.heavy.3.raw

SEQ ID NO: 447849 - DNA, 518 bp, Homo sapiens
  misc_feature: HEFZJCU01D2PRY.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagtcagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttcccctggcaccctcctccaagagcacctctgggggcacagcggccctgggctgcctggtcaaggactacttcctgtcgagcgt

SEQ ID NO: 447850 - DNA, 503 bp, Homo sapiens; identical to SEQ ID NO: 445995
  misc_feature: HEFZJCU01C2BLR.17.25.C03.1.454.heavy.3.raw

SEQ ID NO: 447851 - DNA, 504 bp, Homo sapiens
  misc_feature: HEFZJCU01DQL0W.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccacgtgggggaccg

SEQ ID NO: 447852 - DNA, 449 bp, Homo sapiens; identical to SEQ ID NO: 444889
  misc_feature: HEFZJCU01EOENW.9.53.E09.1.454.heavy.3.raw

SEQ ID NO: 447853 - DNA, 388 bp, Homo sapiens
  misc_feature: HEFZJCU01BIDPB.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgtcagacacggctgtttattactgtgcgagacgactacctggactccaatccatactttgacctattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 447854 - DNA, 380 bp, Homo sapiens
  misc_feature: HEFZJCU01BWR5G.3.70.G04.1.454.heavy.3.raw
agacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttccccctggcgccctgctccaggagcacctccgagagcacagcggccctgggctgcctggtcaaggactacttcgagtgcgtct

SEQ ID NO: 447855 - DNA, 391 bp, Homo sapiens; identical to SEQ ID NO: 446378
  misc_feature: HEFZJCU01DTP0X.16.24.C02.1.454.heavy.3.raw

SEQ ID NO: 447856 - DNA, 431 bp, Homo sapiens
  misc_feature: HEFZJCU01AOMN8.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctgtcaaggactacttccgtatctctcg

SEQ ID NO: 447857 - DNA, 519 bp, Homo sapiens
  misc_feature: HEFZJCU01DZZQZ.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtatttc

SEQ ID NO: 447858 - DNA, 435 bp, Homo sapiens
  misc_feature: HEFZJCU01CTVZ4.40.27.C05.1.454.heavy.3.raw
tctagcgactcacgaccggtgctcgatttagacgcgatcgaagagtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 447859 - DNA, 503 bp, Homo sapiens
  misc_feature: HEFZJCU01CZICR.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggccatcggtcttcccctggcgccctgctccaggagcacctccgagagcacagcggccctgggctgcctggtcaaggactacttccagacgtatca

SEQ ID NO: 447860 - DNA, 483 bp, Homo sapiens
  misc_feature: HEFZJCU01ANQD9.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctggggcacagcggccctgggctgcctggtcaaggactacttccgtatctctcg

SEQ ID NO: 447861 - DNA, 467 bp, Homo sapiens; identical to SEQ ID NO: 445159
  misc_feature: HEFZJCU01ARVHO.48.7.A07.1.454.heavy.3.raw

SEQ ID NO: 447862 - DNA, 499 bp, Homo sapiens
  misc_feature: HEFZJCU01EF2YN.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggcctgggctgcctggtcaaggactacttcctagtacgtga

SEQ ID NO: 447863 - DNA, 499 bp, Homo sapiens
  misc_feature: HEFZJCU01A14DI.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtaccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccatcggtcttcccctggccaccctcctccaagagcacctctgggggcacagcggccctgggctgcctggtcaaggactacttccgagtagtaca

SEQ ID NO: 447864 - DNA, 501 bp, Homo sapiens
  misc_feature: HEFZJCU01EJKLO.51.71.G05.1.454.heavy.3.raw
cgatcgtatacacgaccggtgctcgatttagtgtcgtcgcaagagagagggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggcctgggctgcctggtcaaggactacttccg

SEQ ID NO: 447865 - DNA, 423 bp, Homo sapiens; identical to SEQ ID NO: 446550
  misc_feature: HEFZJCU01BZOBI.11.22.B11.1.454.heavy.3.raw

SEQ ID NO: 447866 - DNA, 512 bp, Homo sapiens
  misc_feature: HEFZJCU01C53Z9.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatatttatacagactccgtgaagggccgcttcaccattctccagagacaattccaagaacacggtgtatctgcaaatgaacagcctgagagccgaggacacggccacataattactgtgcgaagatctcgggctggttccgcggtccgggg

SEQ ID NO: 447867 - DNA, 517 bp, Homo sapiens
  misc_feature: HEFZJCU01C6U09.49.81.H04.1.454.heavy.3.raw
agtcgagagacacgaccggtgctcgatttagtagtgtagattcgcgggggctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctcccagagacaattccaagaacacgctatatttgcacatgaacagcctgagagctgaggacacggctatttattactgtgcgaacttaatcacggaggacaaggggtgacccccgtcctaccg

SEQ ID NO: 447868 - DNA, 507 bp, Homo sapiens
  misc_feature: HEFZJCU01B1PGC.49.65.F10.1.454.heavy.3.raw
agtcgagagacacgaccggtgctcgatttagctacgctctaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcctctggattcaccttcaagaactttggcatgcactgggtccgccaggctccaggcacggggctggagtgggtggcagttatctcagatgatggaggtaaaaagtactattcggactccttgaagggccgattcaccatctccagagacaattccaagaacaccttgcatctacaaatgcacagtctgagacctgaggacacggctgtgtattactgtgcgaagggggaggggagtttttgcattggacccacttgactac

SEQ ID NO: 447869 - DNA, 313 bp, Homo sapiens; identical to SEQ ID NO: 445488
  misc_feature: HEFZJCU01B56T6.49.8.A08.1.454.heavy.3.raw

SEQ ID NO: 447870 - DNA, 507 bp, Homo sapiens; identical to SEQ ID NO: 445401
  misc_feature: HEFZJCU01DA9YC.22.86.H09.1.454.heavy.3.raw

SEQ ID NO: 447871 - DNA, 503 bp, Homo sapiens
  misc_feature: HEFZJCU01EDWP6.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttccccctggcgccctgctccaggagcacctcccgagagcacagcggccctgggctgcctggtcaaggactacttccagtatagtct

SEQ ID NO: 447872 - DNA, 520 bp, Homo sapiens; identical to SEQ ID NO: 445322
  misc_feature: HEFZJCU01EVVZK.13.76.G10.1.454.heavy.3.raw

SEQ ID NO: 447873 - DNA, 515 bp, Homo sapiens
  misc_feature: HEFZJCU01DMXJ7.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaaggcccatcggtcttcccctggcaccctcctccaagagcacctctgggggcacagcggccctggctgcctggtcaaggactacttccagacgtatca

SEQ ID NO: 447874 - DNA, 495 bp, Homo sapiens
  misc_feature: HEFZJCU01EA3WV.4.21.B10.1.454.heavy.3.raw
agcactgtagcacgaccggtgctcgatttagtgtcgtcgcaagagagggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttccccctggcgccctgctccaggagcacctccgagagcacagcggccctgggctgcctggtcaaggactacttccctacagtgct

SEQ ID NO: 447875 - DNA, 396 bp, Homo sapiens
  misc_feature: HEFZJCU01BC0L3.47.46.E02.1.454.heavy.3.raw
agctcacgtacacgaccggtgctcgatttagactcatctacagggaaaggggctggagtgggtctcaagtattgataagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 447876 - DNA, 512 bp, Homo sapiens
  misc_feature: HEFZJCU01EEI00.40.10.A10.1.454.heavy.3.raw
tctagcgactcacgaccggtgctcgatttagcgtcgatctcaggggggtctcagagaggagccttagccctggactccaaggcctttccacttggtgatcagcactgagcacagaggactcaccatggaattggggctgagcggtggtttcgtgtaggcgtactttagtaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgagggacacggctctataattactgttacgagagatttcagcccctcccaaagtggaaattatta

SEQ ID NO: 447877 - DNA, 489 bp, Homo sapiens
  misc_feature: HEFZJCU01BX9HN.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgcctgctccaggagcacctccgagagcacagcggccctgggctgcctggtcaaggactacttcccacgagagta

SEQ ID NO: 447878 - DNA, 379 bp, Homo sapiens; identical to SEQ ID NO: 444450
  misc_feature: HEFZJCU01CBDKO.47.77.G11.1.454.heavy.3.raw

SEQ ID NO: 447879 - DNA, 484 bp, Homo sapiens
  misc_feature: HEFZJCU01ETOQW.49.75.G09.1.454.heavy.3.raw
agtcgagagacacgaccggtgctcgatttagtatagacatcagggggctctgggagaggagcccagcactagaagtcggcggtgtttccattcggtgatcagcactgaacacagaggactcaccatggagtttgggctgagcgtggtttcgtcgtaggcgtctttaagtaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgcttcatcatctccagagacaactccgagaacacgctgtatctgcaaatgaacaggctgagagttgaagacacggctgtatattactgtgcgaacttaatcac

SEQ ID NO: 447880 - DNA, 431 bp, Homo sapiens
  misc_feature: HEFZJCU01D7NUU.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggactacttccgtattctcg

SEQ ID NO: 447881 - DNA, 422 bp, Homo sapiens
  misc_feature: HEFZJCU01E18KX.9.34.D01.1.454.heavy.3.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 447882 - DNA, 491 bp, Homo sapiens; identical to SEQ ID NO: 444803
  misc_feature: HEFZJCU01A91YZ.4.57.F02.1.454.heavy.3.raw

SEQ ID NO: 447883 - DNA, 512 bp, Homo sapiens
  misc_feature: HEFZJCU01D4IX6.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaaggccatcggtcttcccctgcgcctcgctccagagcacctcg

SEQ ID NO: 447884 - DNA, 496 bp, Homo sapiens
  misc_feature: HEFZJCU01B237E.13.67.G01.1.454.heavy.3.raw
tcacgtactacacgaccggtgctcgatttagagtatacatattgggtctgggggaggcttggtacagcctggaaggtccctgagactctcctgtgcagcctctggattcacctttagcagctatgccatgacctgggtccgccaggctccagggaaggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatattactttgactactggggccagggaaccctggtcaccgtctcctcagcctccaccaagggcccatcggtcttcccctggcaccctcctccaagagcacctctgggggcacagcggccctgggctgcctgtcaaggactacttcctagtacgtga

SEQ ID NO: 447885 - DNA, 387 bp, Homo sapiens; identical to SEQ ID NO: 445170
  misc_feature: HEFZJCU01AGS8Z.27.46.E02.1.454.heavy.3.raw

SEQ ID NO: 447886 - DNA, 516 bp, Homo sapiens; identical to SEQ ID NO: 446014
  misc_feature: HEFZJCU01CYOR7.16.10.A10.1.454.heavy.3.raw

SEQ ID NO: 447887 - DNA, 525 bp, Homo sapiens; identical to SEQ ID NO: 445545
  misc_feature: HEFZJCU01DZ0KC.12.86.H09.1.454.heavy.3.raw

SEQ ID NO: 447888 - DNA, 487 bp, Homo sapiens
  misc_feature: HEFZJCU01C104C.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttccccctggcaccctcctccaagagcacctctgggggcacagcggccctgggctgcctggtcaaggctacttcctacgtcgtat

SEQ ID NO: 447889 - DNA, 440 bp, Homo sapiens
  misc_feature: HEFZJCU01EW8FZ.48.59.F04.1.454.heavy.3.raw
agtatacatacacgaccggtgctcgatttagtacacacacttagggattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtgagtcgtggttcgacccctggggccagggtaccctggtcattgtctcctcagcttccaccaagggcccatcggtcttccccctggcgccctgctccaggagcacctctgggggcacagcggccctgggctgcctggtcaaggactacttcctatgtatact

SEQ ID NO: 447890 - DNA, 488 bp, Homo sapiens
  misc_feature: HEFZJCU01DJOA4.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgatttacta

SEQ ID NO: 447891 - DNA, 515 bp, Homo sapiens
  misc_feature: HEFZJCU01ATVVT.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaaccctggtcaccgtctcttcagcctccaccaagggcccatcggtcttcccctcggcaccctcctccaagacgcacctctggggcac

SEQ ID NO: 447892 - DNA, 490 bp, Homo sapiens
  misc_feature: HEFZJCU01BV0MD.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacgggtcaccgtctcctcggcctccaccaagggcccatcggtcttcccctggcgccctgctccaggagcacctccgagagcacagcggccctgggctgcctggtcaaggactacttcccatactcgta

SEQ ID NO: 447893 - DNA, 529 bp, Homo sapiens
  misc_feature: HEFZJCU01EUREY.13.28.C06.1.454.heavy.3.raw
tcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgtttttagtgactattggatgagttgggtccgccaggctccagggaaggggctggagtgggtggccaacataaagtacgatgaagttgagataaattatttggactctgtgaagggccgattcaccatctcgagggacaacgccaagaactcgctgtatctgcaaatggagagcctgagagccgaggacacggctgtatattattgtgtgagattagcgcactactttgactactggggccagggaaccctggtcaccgt

SEQ ID NO: 447894 - DNA, 477 bp, Homo sapiens; identical to SEQ ID NO: 444659
  misc_feature: HEFZJCU01AMFBF.16.10.A10.1.454.heavy.3.raw

SEQ ID NO: 447895 - DNA, 498 bp, Homo sapiens
  misc_feature: HEFZJCU01CEXNO.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctccgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaaccctggtcaccgtctcctcagcctccaccaac

SEQ ID NO: 447896 - DNA, 506 bp, Homo sapiens; identical to SEQ ID NO: 446520
  misc_feature: HEFZJCU01EEQX3.10.38.D05.1.454.heavy.3.raw

SEQ ID NO: 447897 - DNA, 491 bp, Homo sapiens; identical to SEQ ID NO: 444749
  misc_feature: HEFZJCU01ARU2S.11.13.B02.1.454.heavy.3.raw

SEQ ID NO: 447898 - DNA, 505 bp, Homo sapiens
  misc_feature: HEFZJCU01COIOW.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtactac

SEQ ID NO: 447899 - DNA, 523 bp, Homo sapiens; identical to SEQ ID NO: 446270
  misc_feature: HEFZJCU01DB1SI.12.40.D07.1.454.heavy.3.raw

SEQ ID NO: 447900 - DNA, 497 bp, Homo sapiens
  misc_feature: HEFZJCU01ANTRF.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctgggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 447901 - DNA, 531 bp, Homo sapiens
  misc_feature: HEFZJCU01CGUYF.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccgtgaactactggggccagggcaccctggtcaccgtctcctcagcttccaccaagggcccatcggtcttccccctggcgcctcgctccaggagcgacctcctcggggtcggacgacgcggcccgtccgggcgtcgctcggtacgtacggaactacgttaccctaccta

SEQ ID NO: 447902 - DNA, 523 bp, Homo sapiens
  misc_feature: HEFZJCU01EUZPQ.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatgacgtctggggccaagggaccac

SEQ ID NO: 447903 - DNA, 521 bp, Homo sapiens
  misc_feature: HEFZJCU01EMYU4.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgttgcacaccgacgctataccgccagctgggaaatcgacaactggttcgacccctggggccagggaacccttgtcaccgtctcctcacgcctccaccaagggcccacg

SEQ ID NO: 447904 - DNA, 518 bp, Homo sapiens; identical to SEQ ID NO: 447436
  misc_feature: HEFZJCU01EF9TQ.13.76.G10.1.454.heavy.3.raw

SEQ ID NO: 447905 - DNA, 489 bp, Homo sapiens; identical to SEQ ID NO: 444791
  misc_feature: HEFZJCU01E0PYZ.47.85.H08.1.454.heavy.3.raw

SEQ ID NO: 447906 - DNA, 512 bp, Homo sapiens
  misc_feature: HEFZJCU01AFNO7.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggccc

SEQ ID NO: 447907 - DNA, 509 bp, Homo sapiens; identical to SEQ ID NO: 444586
  misc_feature: HEFZJCU01E0PFT.12.78.H01.1.454.heavy.3.raw

SEQ ID NO: 447908 - DNA, 426 bp, Homo sapiens; identical to SEQ ID NO: 444564
  misc_feature: HEFZJCU01BAN4B.9.34.D01.1.454.heavy.3.raw

SEQ ID NO: 447909 - DNA, 509 bp, Homo sapiens
  misc_feature: HEFZJCU01DNPZD.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggaccg

SEQ ID NO: 447910 - DNA, 504 bp, Homo sapiens
  misc_feature: HEFZJCU01DI9N9.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttcccctggcgccctgctccaggagcacctccgagagcacagcggccctgggctgcctggtcaaggactacttcccactacta

SEQ ID NO: 447911 - DNA, 500 bp, Homo sapiens
  misc_feature: HEFZJCU01DICZH.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttattttgtgcgagagaggggtacagtagcggccgagctccggcctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 447912 - DNA, 492 bp, Homo sapiens
  misc_feature: HEFZJCU01APWWF.19.53.E09.1.454.heavy.3.raw
tactctcgtgcacgaccggtgctcgatttagagagagtgtgttgagtctgggggaggcttggtacagcctggcaggtccctgagactctcctgtgcagcctctggattcaccttttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactgggccagggaaccctggtcaccgtctcctcagcctccaccaagggcccatcggtcttcccctggcgccctgctccaggagcacctccgagagcacagcggccctgggctgcctggtcaaggactacttcccacgacgagta

SEQ ID NO: 447913 - DNA, 518 bp, Homo sapiens; identical to SEQ ID NO: 444718
  misc_feature: HEFZJCU01AF42P.9.34.D01.1.454.heavy.3.raw

SEQ ID NO: 447914 - DNA, 374 bp, Homo sapiens; identical to SEQ ID NO: 444640
  misc_feature: HEFZJCU01BIZX4.7.37.D04.1.454.heavy.3.raw

SEQ ID NO: 447915 - DNA, 533 bp, Homo sapiens
  misc_feature: HEFZJCU01C1IIP.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgttacgagagcgtcgtctgtcagtggaattgactactgggccagggaaccctggtcaccggtctccttcagcctccaccaaggg

SEQ ID NO: 447916 - DNA, 517 bp, Homo sapiens
  misc_feature: HEFZJCU01AD5MA.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactgaagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggaccaa

SEQ ID NO: 447917 - DNA, 519 bp, Homo sapiens; identical to SEQ ID NO: 444867
  misc_feature: HEFZJCU01AEFE8.9.34.D01.1.454.heavy.3.raw

SEQ ID NO: 447918 - DNA, 315 bp, Homo sapiens; identical to SEQ ID NO: 444422
  misc_feature: HEFZJCU01B4SSG.47.84.H07.1.454.heavy.3.raw

SEQ ID NO: 447919 - DNA, 502 bp, Homo sapiens
  misc_feature: HEFZJCU01D53G7.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcggtcggtttcgtcgtaggcgtcttaagtagatgtcagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctgggtt

SEQ ID NO: 447920 - DNA, 516 bp, Homo sapiens; identical to SEQ ID NO: 445479
  misc_feature: HEFZJCU01EVL8O.9.34.D01.1.454.heavy.3.raw

SEQ ID NO: 447921 - DNA, 517 bp, Homo sapiens
  misc_feature: HEFZJCU01DJH0S.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 447922 - DNA, 497 bp, Homo sapiens; identical to SEQ ID NO: 445179
  misc_feature: HEFZJCU01AU643.12.55.E11.1.454.heavy.3.raw

SEQ ID NO: 447923 - DNA, 522 bp, Homo sapiens
  misc_feature: HEFZJCU01ENDHJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggaccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtcttcccctggcg

SEQ ID NO: 447924 - DNA, 509 bp, Homo sapiens
  misc_feature: HEFZJCU01DKHSY.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgttttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacgggccacatattactgtgcgaaagatctcgggctggttccgcggtccggg

SEQ ID NO: 447925 - DNA, 413 bp, Homo sapiens
  misc_feature: HEFZJCU01C74DV.51.79.H02.1.454.heavy.3.raw
cgatcgtatacacgaccggtgctcgatttagtgtcacacgaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 447926 - DNA, 487 bp, Homo sapiens; identical to SEQ ID NO: 445219
  misc_feature: HEFZJCU01D8VET.10.85.H08.1.454.heavy.3.raw

SEQ ID NO: 447927 - DNA, 480 bp, Homo sapiens; identical to SEQ ID NO: 445011
  misc_feature: HEFZJCU01CDZJI.22.36.D03.1.454.heavy.3.raw

SEQ ID NO: 447928 - DNA, 509 bp, Homo sapiens
  misc_feature: HEFZJCU01EGE8H.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccattcaccatctccagagacaattccaggaacacaatgtatttggaaatgaacagcctaagtcctgaggacacgggtgtatactactgtacgaaggagggggaacagcggagtccagtactcttgacgtctgggcctac

SEQ ID NO: 447929 - DNA, 314 bp, Homo sapiens; identical to SEQ ID NO: 444774
  misc_feature: HEFZJCU01CLBC8.7.10.A10.1.454.heavy.3.raw

SEQ ID NO: 447930 - DNA, 525 bp, Homo sapiens
  misc_feature: HEFZJCU01EBIIC.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccagagcacctctgggggcacagcggccctgggctgcctggtcaaggactacttccg

SEQ ID NO: 447931 - DNA, 504 bp, Homo sapiens
  misc_feature: HEFZJCU01D6RIZ.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtccacccatactactttgactacgt

SEQ ID NO: 447932 - DNA, 492 bp, Homo sapiens; identical to SEQ ID NO: 445919
  misc_feature: HEFZJCU01CGF8P.14.25.C03.1.454.heavy.3.raw

SEQ ID NO: 447933 - DNA, 372 bp, Homo sapiens
  misc_feature: HEFZJCU01AGHCG.49.45.E01.1.454.heavy.3.raw
agtcgagagacacgaccggtgctcgatttagtgagtcagtaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 447934 - DNA, 491 bp, Homo sapiens; identical to SEQ ID NO: 444592
  misc_feature: HEFZJCU01AU0VS.11.26.C04.1.454.heavy.3.raw

SEQ ID NO: 447935 - DNA, 512 bp, Homo sapiens; identical to SEQ ID NO: 445688
  misc_feature: HEFZJCU01A7N64.3.34.D01.1.454.heavy.3.raw

SEQ ID NO: 447936 - DNA, 436 bp, Homo sapiens
  misc_feature: HEFZJCU01AU7BN.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaggactacttccgagtgcgtct

SEQ ID NO: 447937 - DNA, 483 bp, Homo sapiens; identical to SEQ ID NO: 444639
  misc_feature: HEFZJCU01BKRMY.11.23.C01.1.454.heavy.3.raw

SEQ ID NO: 447938 - DNA, 486 bp, Homo sapiens
  misc_feature: HEFZJCU01D6WE1.12.40.D07.1.454.heavy.3.raw
atacgacgtacacgaccggtgctcgatttagtgatagagcgtaacaacagaggactcaccatgggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttcccctggcgccctgctccaggagcacctccgagagcacagcggccctgggctgcctggtcaaggactacttcctacgtcgtat

SEQ ID NO: 447939 - DNA, 509 bp, Homo sapiens
  misc_feature: HEFZJCU01A6DDM.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccaggggacg

SEQ ID NO: 447940 - DNA, 515 bp, Homo sapiens
  misc_feature: HEFZJCU01C514P.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctcgtggggccaggggtaa

SEQ ID NO: 447941 - DNA, 477 bp, Homo sapiens; identical to SEQ ID NO: 444659
  misc_feature: HEFZJCU01D10VU.16.10.A10.1.454.heavy.3.raw

SEQ ID NO: 447942 - DNA, 381 bp, Homo sapiens; identical to SEQ ID NO: 444427
  misc_feature: HEFZJCU01CGJO2.9.53.E09.1.454.heavy.3.raw

SEQ ID NO: 447943 - DNA, 482 bp, Homo sapiens; identical to SEQ ID NO: 444503
  misc_feature: HEFZJCU01BTOL8.7.10.A10.1.454.heavy.3.raw

SEQ ID NO: 447944 - DNA, 429 bp, Homo sapiens
  misc_feature: HEFZJCU01DB149.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatgga

SEQ ID NO: 447945 - DNA, 391 bp, Homo sapiens; identical to SEQ ID NO: 444514
  misc_feature: HEFZJCU01DJ42Y.12.24.C02.1.454.heavy.3.raw

SEQ ID NO: 447946 - DNA, 395 bp, Homo sapiens
  misc_feature: HEFZJCU01DKDBE.47.46.E02.1.454.heavy.3.raw
agctcacgtacacgaccggtgctcgatttagactcatctacaggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactattcctacgtgagct

SEQ ID NO: 447947 - DNA, 339 bp, Homo sapiens
  misc_feature: HEFZJCU01CYRQJ.49.58.F03.1.454.heavy.3.raw
agtcgagagacacgaccggtgctcgatttagtctgatcgagaagggaaagggccgattcatcatctccagagacaactccgagaacacgctgtatctgcaaatgaacaggctgagagctgaagacacggctttatattactgtgcgaacttaatcacggaggacaacggtgaccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 447948 - DNA, 492 bp, Homo sapiens
  misc_feature: HEFZJCU01BUB0A.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagatatcgcggtgta

SEQ ID NO: 447949 - DNA, 381 bp, Homo sapiens; identical to SEQ ID NO: 445431
  misc_feature: HEFZJCU01BD0P1.3.70.G04.1.454.heavy.3.raw

SEQ ID NO: 447950 - DNA, 387 bp, Homo sapiens; identical to SEQ ID NO: 444635
  misc_feature: HEFZJCU01DV4OX.11.27.C05.1.454.heavy.3.raw

SEQ ID NO: 447951 - DNA, 384 bp, Homo sapiens; identical to SEQ ID NO: 445394
  misc_feature: HEFZJCU01ALZT2.22.46.E02.1.454.heavy.3.raw

SEQ ID NO: 447952 - DNA, 499 bp, Homo sapiens; identical to SEQ ID NO: 446805
  misc_feature: HEFZJCU01DIVSY.3.20.B09.1.454.heavy.3.raw

SEQ ID NO: 447953 - DNA, 507 bp, Homo sapiens
  misc_feature: HEFZJCU01AXK6Q.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggctactcctacgtcgtat

SEQ ID NO: 447954 - DNA, 491 bp, Homo sapiens; identical to SEQ ID NO: 444592
  misc_feature: HEFZJCU01CN6GH.11.26.C04.1.454.heavy.3.raw

SEQ ID NO: 447955 - DNA, 480 bp, Homo sapiens; identical to SEQ ID NO: 445011
  misc_feature: HEFZJCU01B2WIK.22.36.D03.1.454.heavy.3.raw

SEQ ID NO: 447956 - DNA, 512 bp, Homo sapiens; identical to SEQ ID NO: 445688
  misc_feature: HEFZJCU01BS84J.3.34.D01.1.454.heavy.3.raw

SEQ ID NO: 447957 - DNA, 380 bp, Homo sapiens; identical to SEQ ID NO: 445008
  misc_feature: HEFZJCU01EEQBE.2.86.H09.1.454.heavy.3.raw

SEQ ID NO: 447958 - DNA, 482 bp, Homo sapiens; identical to SEQ ID NO: 444503
  misc_feature: HEFZJCU01DBO98.7.10.A10.1.454.heavy.3.raw

SEQ ID NO: 447959 - DNA, 491 bp, Homo sapiens; identical to SEQ ID NO: 444749
  misc_feature: HEFZJCU01CSAHK.11.13.B02.1.454.heavy.3.raw

SEQ ID NO: 447960 - DNA, 395 bp, Homo sapiens
  misc_feature: HEFZJCU01B7VTP.10.42.D09.1.454.heavy.3.raw
catagtagtgcacgaccggtgctcgatttagacacatacgcagggaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 447961 - DNA, 482 bp, Homo sapiens
  misc_feature: HEFZJCU01BSKQJ.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtattttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 447962 - DNA, 530 bp, Homo sapiens
  misc_feature: HEFZJCU01BK4NO.13.62.F07.1.454.heavy.3.raw
tcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctgggccagggaaccctggtc

SEQ ID NO: 447963 - DNA, 516 bp, Homo sapiens
  misc_feature: HEFZJCU01C3VLL.13.75.G09.1.454.heavy.3.raw
tcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcccgaaagaggaaagtggctacgatttgggaagtactactacatggacgtctggggcaagggaccacggtcacgtctcctcag

SEQ ID NO: 447964 - DNA, 384 bp, Homo sapiens
  misc_feature: HEFZJCU01A0534.13.61.F06.1.454.heavy.3.raw
tcacgtactacacgaccggtgctcgatttagctacgctctaagggaaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 447965 - DNA, 501 bp, Homo sapiens
  misc_feature: HEFZJCU01ECA7C.17.10.A10.1.454.heavy.3.raw
cgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctc

SEQ ID NO: 447966 - DNA, 506 bp, Homo sapiens; identical to SEQ ID NO: 444696
  misc_feature: HEFZJCU01ELA8G.16.34.D01.1.454.heavy.3.raw

SEQ ID NO: 447967 - DNA, 506 bp, Homo sapiens; identical to SEQ ID NO: 445682
  misc_feature: HEFZJCU01A97GW.48.44.D11.1.454.heavy.3.raw

SEQ ID NO: 447968 - DNA, 480 bp, Homo sapiens
  misc_feature: HEFZJCU01DCZ81.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcgccctgggctgcctggtcaggactacttccgtatctctcg

SEQ ID NO: 447969 - DNA, 407 bp, Homo sapiens; identical to SEQ ID NO: 445632
  misc_feature: HEFZJCU01DGLMZ.11.67.G01.1.454.heavy.3.raw

SEQ ID NO: 447970 - DNA, 524 bp, Homo sapiens; identical to SEQ ID NO: 445902
  misc_feature: HEFZJCU01BWCL7.9.78.H01.1.454.heavy.3.raw

SEQ ID NO: 447971 - DNA, 532 bp, Homo sapiens
  misc_feature: HEFZJCU01A8GJM.51.26.C04.1.454.heavy.3.raw
  modified_base (524)..(524): a, c, t, g, unknown or other
cgatcgtatacacgaccggtgctcgatttagtctagcgactttgggtttgggctgagcgtggtttcgtcgtaggctctttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaaggggaccacggtcaccgtctccttagcctccaccaagggcccatcggtcttccccctggcaccctcctccaagngcacctct

SEQ ID NO: 447972 - DNA, 506 bp, Homo sapiens
  misc_feature: HEFZJCU01EQX2Z.5.6.A06.1.454.heavy.3.raw
atcagacacgcacgaccggtgctcgatttagatctactgacaggggtctcagagaggtgccttagccctggattccaaggcatttccacttggtgatcagcactgaacacagaggactcaccatggagttggggctgcgctgggttttccttgttgctattttagaaggtgtccagtgtgaggtgcagctggtggagtctgggggaaagttggtgcagcctggggagtccctgagactctcctgtgaaggcgctggatttaccctcagttcctataaaatgggctgggtccgccaggctccagggaaggggctggagtggctttcaatcatctacagtagtgggagtgtcatttattacgcggactctgtgaagggccgattcaccatttccagagacaacgccaagaactcactgtatctgcaaatgaacagcctgagagccgaggacacggctgtatattactgtgcgagagatctgggggccaacagttggccctactttgta

SEQ ID NO: 447973 - DNA, 516 bp, Homo sapiens; identical to SEQ ID NO: 445176
  misc_feature: HEFZJCU01DWB2N.14.66.F11.1.454.heavy.3.raw

SEQ ID NO: 447974 - DNA, 487 bp, Homo sapiens
  misc_feature: HEFZJCU01BV6V3.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctgcgccctgctccaggagcacctccgagagcacagcggcctgggctgcctggtcaaggactacttcctacgtgagct

SEQ ID NO: 447975 - DNA, 518 bp, Homo sapiens
  misc_feature: HEFZJCU01B6Y2A.48.33.C11.1.454.heavy.3.raw
agtatacatacacgaccggtgctcgatttagagtgagctcgttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtggtcgtggcagtggctggtacgtggctctcagtggttcgacccctggggccagggatacctggtcaccgtctcctcagcttccaccaac

SEQ ID NO: 447976 - DNA, 501 bp, Homo sapiens
  misc_feature: HEFZJCU01DERK1.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgacgagcacagcggccctgggctgcctggtcaaggactacttcctacgtcgtat

SEQ ID NO: 447977 - DNA, 304 bp, Homo sapiens
  misc_feature: HEFZJCU01D61VF.48.78.H01.1.454.heavy.3.raw
agtatacatacacgaccggtgctcgatttagtgtgagtagtttgggtttgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 447978 - DNA, 384 bp, Homo sapiens; identical to SEQ ID NO: 444454
  misc_feature: HEFZJCU01ESQ4C.11.61.F06.1.454.heavy.3.raw

SEQ ID NO: 447979 - DNA, 491 bp, Homo sapiens
  misc_feature: HEFZJCU01B3LWP.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctggtggagtctgggggaggcttggtacagcctgggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaagatttgggaatgaccacgtc

SEQ ID NO: 447980 - DNA, 515 bp, Homo sapiens
  misc_feature: HEFZJCU01CKQEH.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccaggcgggagttccaagtactccttgtacg

SEQ ID NO: 447981 - DNA, 491 bp, Homo sapiens
  misc_feature: HEFZJCU01ERNNE.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 447982 - DNA, 530 bp, Homo sapiens
  misc_feature: HEFZJCU01ED3PQ.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaaggacttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctggggggcacagcggccctgggctgcctggtcaaggactacttccg

SEQ ID NO: 447983 - DNA, 373 bp, Homo sapiens; identical to SEQ ID NO: 445532
  misc_feature: HEFZJCU01A6GCN.7.37.D04.1.454.heavy.3.raw

SEQ ID NO: 447984 - DNA, 523 bp, Homo sapiens
  misc_feature: HEFZJCU01C97ED.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggccctggg

SEQ ID NO: 447985 - DNA, 516 bp, Homo sapiens
  misc_feature: HEFZJCU01DPHFE.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaggcgattcaccatctccagagacaattccaggaacacaatgtatttggagctgaacagcctaagtcctgaggacacgggcgtatactactgtacgaaggaaggggggaaccgaggcgggagttccgaagtactcctttgtacg

SEQ ID NO: 447986 - DNA, 487 bp, Homo sapiens
  misc_feature: HEFZJCU01C3GO6.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctgggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 447987 - DNA, 317 bp, Homo sapiens; identical to SEQ ID NO: 444484
  misc_feature: HEFZJCU01B3PFH.13.66.F11.1.454.heavy.3.raw

SEQ ID NO: 447988 - DNA, 483 bp, Homo sapiens; identical to SEQ ID NO: 444639
  misc_feature: HEFZJCU01E0SS2.11.23.C01.1.454.heavy.3.raw

SEQ ID NO: 447989 - DNA, 486 bp, Homo sapiens; identical to SEQ ID NO: 444861
  misc_feature: HEFZJCU01A9M05.47.55.E11.1.454.heavy.3.raw

SEQ ID NO: 447990 - DNA, 514 bp, Homo sapiens
  misc_feature: HEFZJCU01CKJVD.15.28.C06.1.454.heavy.3.raw
tctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctcctcagcctccaccaagggcccatcggtcttcccctggcgccctgctccaggagcacctccgagagcacagcggccctgggctgcctggtcaaggactacttccgctacgtaga

SEQ ID NO: 447991 - DNA, 504 bp, Homo sapiens
  misc_feature: HEFZJCU01C1CV3.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccattactactgtgcgcggggaggtggacggagctcggttttcggagtttatcatctactactttg

SEQ ID NO: 447992 - DNA, 514 bp, Homo sapiens
  misc_feature: HEFZJCU01EGB8T.48.19.B08.1.454.heavy.3.raw
agtatacatacacgaccggtgctcgatttagtgagtcagtaagggggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccgtctcctcagcctccaccaac

SEQ ID NO: 447993 - DNA, 507 bp, Homo sapiens; identical to SEQ ID NO: 446719
  misc_feature: HEFZJCU01DYX1K.48.44.D11.1.454.heavy.3.raw

SEQ ID NO: 447994 - DNA, 495 bp, Homo sapiens
  misc_feature: HEFZJCU01C6SNV.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctggggcacagcggccctgggctgcctggtcaggactacttcctacgtcgtat

SEQ ID NO: 447995 - DNA, 491 bp, Homo sapiens
  misc_feature: HEFZJCU01DMW4B.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggagtcgatattgt

SEQ ID NO: 447996 - DNA, 502 bp, Homo sapiens
  misc_feature: HEFZJCU01C1BPR.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgttctgcaaatggacagcctgagagccgaggacacggctgtatattactgtgcgagagatatgagaaactcaatgatagaaatcagggatgggggccagggaaccctggtcaccgtctcctcagcctccaccaaggcccatcggtcttccctcggcgccctgctccacggagcgacctccgacgagcacagcggccctcgggctgcctggtcaaggactacttccga

SEQ ID NO: 447997 - DNA, 531 bp, Homo sapiens
  misc_feature: HEFZJCU01CS0AC.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactacgtggggccagggaaccctggtcaccgtctcctcagcctccaccaagg

SEQ ID NO: 447998 - DNA, 384 bp, Homo sapiens; identical to SEQ ID NO: 444454
  misc_feature: HEFZJCU01CEM63.11.61.F06.1.454.heavy.3.raw

SEQ ID NO: 447999 - DNA, 521 bp, Homo sapiens
  misc_feature: HEFZJCU01A6R54.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaaggggtcaccgtctccgcagcctccaccg

SEQ ID NO: 448000 - DNA, 395 bp, Homo sapiens; identical to SEQ ID NO: 444517
  misc_feature: HEFZJCU01D6PBP.16.68.G02.1.454.heavy.3.raw

SEQ ID NO: 448001 - DNA, 524 bp, Homo sapiens
  misc_feature: HEFZJCU01EU5Z6.48.12.B01.1.454.heavy.3.raw
agtatacatacacgaccggtgctcgatttagtagtgtagattccgcggggatgctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaacacccactacaatccgtccctcaagagtcgagtcaccatatccgtggacacgtccaagaacgagttctcctgaggttacaatctgtgaccgccgcagacacggctgtatattactgtgcgagacaccggggagggggcttactatggatcgggcgggaggttactactttgactactggggccagggagtcctggtcaccgtct

SEQ ID NO: 448002 - DNA, 508 bp, Homo sapiens
  misc_feature: HEFZJCU01EXWHD.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggcctgggctgcctggtcaaggactacttcctacgtcgtat

SEQ ID NO: 448003 - DNA, 528 bp, Homo sapiens
  misc_feature: HEFZJCU01CJVCS.7.78.H01.1.454.heavy.3.raw
cgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgagaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaccttcaacctgacgacactgccgtttattttgtacgagagcgtcgtctgtcagtggaattgactactggggccagggaaccctggtcaccgtctcctcagcctccaccaaggg

SEQ ID NO: 448004 - DNA, 449 bp, Homo sapiens; identical to SEQ ID NO: 444589
  misc_feature: HEFZJCU01C14P1.53.57.F02.1.454.heavy.3.raw

SEQ ID NO: 448005 - DNA, 530 bp, Homo sapiens
  misc_feature: HEFZJCU01DJE5S.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagtgggagcaccaactacaacccctccctcaagagtcgagtcaccatatcagtggacacgtccaagaaccagttctccctgaagctgagctctgtgaccgctgcggacacggccgtgtattactgtgcgagctggggttcagggtactttgactactggggccagggaaccctggtcaccgtctcctcagcctccaccaagggcccatcggtcttcccctggccaccctcctccaagacgcacctctgggggcacagcggccctgggctgcctggtcaaggctactcctagtacgtgta

SEQ ID NO: 448006 - DNA, 467 bp, Homo sapiens; identical to SEQ ID NO: 445004
  misc_feature: HEFZJCU01C8VZE.16.78.H01.1.454.heavy.3.raw

SEQ ID NO: 448007 - DNA, 496 bp, Homo sapiens
  misc_feature: HEFZJCU01BPKSC.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccatctcctcagcctccaccaagggcccatcggtcttcccctggcaccctcctccaagagcacctctgggggcacagcggccctgggctgcctggtcaaggactacttccgagtagtaca

SEQ ID NO: 448008 - DNA, 531 bp, Homo sapiens
  misc_feature: HEFZJCU01EHKNS.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcagtatcttttacagtgggagcaccaactacaacccctccctcaagagtcgagtcaccatatcagtggacacgtccaagaaccagttctccctgaagctgagctctgtgaccgctgcggacacggccgtgtattactgtgcgagctggggttcagggtactttgactactggggccagggaaccctggtcaccgtctcctcagcctccaccaagggcccatcggtcttccccctggccaccctcctccaagacgcacctctggggcacagcggccctgggctgcctggtcaaggctacttccgtactagacg

SEQ ID NO: 448009 - DNA, 516 bp, Homo sapiens
  misc_feature: HEFZJCU01EEH4B.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtattactgttcgtttggttctgactcgtcgggggaataccttcagcactggggccac

SEQ ID NO: 448010 - DNA, 506 bp, Homo sapiens
  misc_feature: HEFZJCU01CS6PI.48.34.D01.1.454.heavy.3.raw
agtatacatacacgaccggtgctcgatttagatcgtctgtgttgggtttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccttctcctcagcctccaccaagggcccatcggtcttcccctggcgccctgctccaggagcacctccgagagcacagcggccctgggctgcctggtcaaggactacttcctatgtatact

SEQ ID NO: 448011 - DNA, 511 bp, Homo sapiens; identical to SEQ ID NO: 447160
  misc_feature: HEFZJCU01C8ARO.14.25.C03.1.454.heavy.3.raw

SEQ ID NO: 448012 - DNA, 312 bp, Homo sapiens
  misc_feature: HEFZJCU01B9R40.49.8.A08.1.454.heavy.3.raw
agtcgagagacacgaccggtgctcgatttagcatactctacagggacaattccgagaacacgctgtatctgcaaatgaacagcctgagagctgaggacacggctgtgtattactgtgcgaacttaatcacggaggacaacggtgaccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 448013 - DNA, 522 bp, Homo sapiens; identical to SEQ ID NO: 446367
  misc_feature: HEFZJCU01CE0Z0.51.62.F07.1.454.heavy.3.raw

SEQ ID NO: 448014 - DNA, 490 bp, Homo sapiens
  misc_feature: HEFZJCU01EBPGF.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggccgcctgctccaggagcacctctgggggcacagcggccctgggctgcctggtcaaggactacttcctatgtatact

SEQ ID NO: 448015 - DNA, 483 bp, Homo sapiens; identical to SEQ ID NO: 444639
  misc_feature: HEFZJCU01ASIJY.11.23.C01.1.454.heavy.3.raw

SEQ ID NO: 448016 - DNA, 522 bp, Homo sapiens
  misc_feature: HEFZJCU01DU3WH.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggcg

SEQ ID NO: 448017 - DNA, 523 bp, Homo sapiens
  misc_feature: HEFZJCU01EA2PJ.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagccgcgggggtcacccaaattgactactggggccagggaaccctggtcaccgtctcctcagcctccaccaagggcccatcggtcttcccctggccgccctgctcca

SEQ ID NO: 448018 - DNA, 496 bp, Homo sapiens; identical to SEQ ID NO: 444697
  misc_feature: HEFZJCU01CU9E6.16.37.D04.1.454.heavy.3.raw

SEQ ID NO: 448019 - DNA, 396 bp, Homo sapiens; identical to SEQ ID NO: 444469
  misc_feature: HEFZJCU01ADD6E.47.46.E02.1.454.heavy.3.raw

SEQ ID NO: 448020 - DNA, 509 bp, Homo sapiens
  misc_feature: HEFZJCU01BTC5J.48.53.E09.1.454.heavy.3.raw
agtatacatacacgaccggtgctcgatttagagagagtgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggccatcggtcttcccctggcgccctgctccaggagcacctccgagagcacagcggccctgggctgcctggtcaaggactactt

SEQ ID NO: 448021 - DNA, 460 bp, Homo sapiens; identical to SEQ ID NO: 444688
  misc_feature: HEFZJCU01EKRK1.53.12.B01.1.454.heavy.3.raw

SEQ ID NO: 448022 - DNA, 422 bp, Homo sapiens; identical to SEQ ID NO: 444681
  misc_feature: HEFZJCU01EOXES.16.78.H01.1.454.heavy.3.raw

SEQ ID NO: 448023 - DNA, 498 bp, Homo sapiens
  misc_feature: HEFZJCU01BAQAQ.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgactac

SEQ ID NO: 448024 - DNA, 492 bp, Homo sapiens
  misc_feature: HEFZJCU01EZ684.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccaggggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 448025 - DNA, 313 bp, Homo sapiens
  misc_feature: HEFZJCU01DNMC8.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcttagagacacg

SEQ ID NO: 448026 - DNA, 432 bp, Homo sapiens; identical to SEQ ID NO: 444920
  misc_feature: HEFZJCU01D4UYW.11.39.D06.1.454.heavy.3.raw

SEQ ID NO: 448027 - DNA, 494 bp, Homo sapiens
  misc_feature: HEFZJCU01CYU9N.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccctggcgccctgctccaggagcacctctggggcacagcggcctggctgcctggtcaggactacttcctacgtcgtat

SEQ ID NO: 448028 - DNA, 477 bp, Homo sapiens
  misc_feature: HEFZJCU01CWWJR.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctcaagagacacttccgagaacacgctgtatctgcgaatgaacagcctgagagtcgaggacacggccatatattactgtgtgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 448029 - DNA, 481 bp, Homo sapiens
  misc_feature: HEFZJCU01AYIXO.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccaggggacacgtccatcagcacgtccatcagcacagcctacatggacctgagcggcctgacatctgacgacacggccgtatatttctgtgcgagggagt

SEQ ID NO: 448030 - DNA, 482 bp, Homo sapiens; identical to SEQ ID NO: 444503
  misc_feature: HEFZJCU01EPSPJ.7.10.A10.1.454.heavy.3.raw

SEQ ID NO: 448031 - DNA, 510 bp, Homo sapiens
  misc_feature: HEFZJCU01DSCUY.21.70.G04.1.454.heavy.3.raw
tcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccaggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttccctgcgccctgctccaggagcacctccagagcac

SEQ ID NO: 448032 - DNA, 507 bp, Homo sapiens
  misc_feature: HEFZJCU01COLL3.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaaggcccatccggtcttcccctggcgccctgctccaggacgcacctccgagagcacagccggcctc

SEQ ID NO: 448033 - DNA, 508 bp, Homo sapiens
  misc_feature: HEFZJCU01DMNTN.48.34.D01.1.454.heavy.3.raw
agtatacatacacgaccggtgctcgatttagatcgtctgtgttgggtcgggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctcaccaagggcccatcggtcttcccctggcgccctgctccaggagcacctccgagagcacagcggccctgggctgcctggtcaaggactacttcctatgtatat

SEQ ID NO: 448034 - DNA, 385 bp, Homo sapiens
  misc_feature: HEFZJCU01DNC9Q.13.24.C02.1.454.heavy.3.raw
tcacgtactacacgaccggtgctcgatttagtacagatcgttagggaaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 448035 - DNA, 356 bp, Homo sapiens; identical to SEQ ID NO: 444460
  misc_feature: HEFZJCU01DVW22.47.38.D05.1.454.heavy.3.raw

SEQ ID NO: 448036 - DNA, 491 bp, Homo sapiens
  misc_feature: HEFZJCU01D9KTC.11.13.B02.1.454.heavy.3.raw
cgagagataccacgaccggtgctcgatttagtctagcgactttgggcctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 448037 - DNA, 518 bp, Homo sapiens
  misc_feature: HEFZJCU01C0FYR.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaatattggtgggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcaccgtctccgcagcctccaccg

SEQ ID NO: 448038 - DNA, 494 bp, Homo sapiens
  misc_feature: HEFZJCU01CJT01.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgacgagcacagcggcccgtgggctgcctggtcaaggactacttccgtatctctcg

SEQ ID NO: 448039 - DNA, 517 bp, Homo sapiens
  misc_feature: HEFZJCU01DFGWI.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgagacacggctgtgtattactgtgtgagagatgtctgcgttggggccaggggaaccctggtctaccg

SEQ ID NO: 448040 - DNA, 483 bp, Homo sapiens; identical to SEQ ID NO: 444924
  misc_feature: HEFZJCU01D1MAD.10.35.D02.1.454.heavy.3.raw

SEQ ID NO: 448041 - DNA, 470 bp, Homo sapiens; identical to SEQ ID NO: 444866
  misc_feature: HEFZJCU01EZG2B.4.36.D03.1.454.heavy.3.raw

SEQ ID NO: 448042 - DNA, 524 bp, Homo sapiens
  misc_feature: HEFZJCU01AFDVA.48.35.D02.1.454.heavy.3.raw
agtatacatacacgaccggtgctcgatttagcacacgatagttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgaccagcaactggttcgacccctggggccgagggaaccctggtcaccgtctcctcagcctccaccaaggcccatcggtcttcccctggcaccctcctccaagagcacctctggggcacg

SEQ ID NO: 448043 - DNA, 523 bp, Homo sapiens
  misc_feature: HEFZJCU01C5V0H.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggttggggtgaggtctgtgtcactgtggtatgacgatttttggcgttggtttttccttcactattactcccactactacggtttggacgtctggggccaagggaccacggtcaccgtctcctcagcctccaccaagggcccatcggtcttcccctggcaccctcctccaagagcacctctgggggcacagcggccctgggctgcctggtcaaggactactcctcgtactgcg

SEQ ID NO: 448044 - DNA, 392 bp, Homo sapiens; identical to SEQ ID NO: 444456
  misc_feature: HEFZJCU01BH5EF.7.60.F05.1.454.heavy.3.raw

SEQ ID NO: 448045 - DNA, 400 bp, Homo sapiens; identical to SEQ ID NO: 444452
  misc_feature: HEFZJCU01E1022.47.24.C02.1.454.heavy.3.raw

SEQ ID NO: 448046 - DNA, 434 bp, Homo sapiens
  misc_feature: HEFZJCU01DKM9M.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttcccctggcgcctgctccaggagcacctccgagagcacagcggcctgggctgcctggtcaaggactacttccgagtgcgtct

SEQ ID NO: 448047 - DNA, 493 bp, Homo sapiens
  misc_feature: HEFZJCU01B7RC1.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttattctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaggactacttccctacagtgct

SEQ ID NO: 448048 - DNA, 391 bp, Homo sapiens
  misc_feature: HEFZJCU01DM6SS.40.30.C08.1.454.heavy.3.raw
tctagcgactcacgaccggtgctcgatttagtctgacgtcaaagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 448049 - DNA, 500 bp, Homo sapiens
  misc_feature: HEFZJCU01DS49C.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgactcctggggccagggaaccctggtcgtcgtctcgtctgcctccaccaagggcccatcggtcttcccctggcgccctgctccaggagcacctccgagagcacagcggccctgggctgcctggtcaaggactacttcctagtacgtga

SEQ ID NO: 448050 - DNA, 533 bp, Homo sapiens
  misc_feature: HEFZJCU01D6IPG.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaggcc

SEQ ID NO: 448051 - DNA, 514 bp, Homo sapiens
  misc_feature: HEFZJCU01DIZAM.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtggtttccgtgtaggctattttaaaaggtgccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaaggg

SEQ ID NO: 448052 - DNA, 507 bp, Homo sapiens
  misc_feature: HEFZJCU01C4KJQ.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgcgggacttctgggccagggaacctc

SEQ ID NO: 448053 - DNA, 529 bp, Homo sapiens; identical to SEQ ID NO: 446480
  misc_feature: HEFZJCU01DS6GF.18.33.C11.1.454.heavy.3.raw

SEQ ID NO: 448054 - DNA, 481 bp, Homo sapiens
  misc_feature: HEFZJCU01AKXCG.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccacgcgtatgt

SEQ ID NO: 448055 - DNA, 492 bp, Homo sapiens; identical to SEQ ID NO: 444827
  misc_feature: HEFZJCU01CN6K6.4.28.C06.1.454.heavy.3.raw

SEQ ID NO: 448056 - DNA, 513 bp, Homo sapiens
  misc_feature: HEFZJCU01EKTE5.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctggggccgtggcaccctggtcactgtctcctcggcttccaccaagggcccatcggtcttcccctggcgccctgctccaggagcacctctgggggcacagcggcccg

SEQ ID NO: 448057 - DNA, 529 bp, Homo sapiens
  misc_feature: HEFZJCU01BRHUE.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccagggaaccctggtcaccgtctcctcagcctccaaccg

SEQ ID NO: 448058 - DNA, 379 bp, Homo sapiens; identical to SEQ ID NO: 444450
  misc_feature: HEFZJCU01A6E75.47.77.G11.1.454.heavy.3.raw

SEQ ID NO: 448059 - DNA, 491 bp, Homo sapiens
  misc_feature: HEFZJCU01DP58B.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaaatgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 448060 - DNA, 408 bp, Homo sapiens
  misc_feature: HEFZJCU01DNAU2.40.23.C01.1.454.heavy.3.raw
tctagcgactcacgaccggtgctcgatttagtacacgtgattagggattgggggcctggagtgggtctcaggtattagttggaatagtggaagtattgactatggggactctgtgaagggccgattcaccatctccagagacaacgccaagaactccctgtatctgcaaatgagcagtctgagagctgaggacacggccttgtattactgtgcaaaagatactaggggaatagtagtgtctcggcggcttggtgcttttgatatctggggccaagggacaatggtcaccgtctcttcagcctccaccaagggcccatcggtcttccccctggcgccctgctccaggagcacctccgagagcacagcggccctgggctgcctggtcaaggactacttccagtcgctaga

SEQ ID NO: 448061 - DNA, 505 bp, Homo sapiens
  misc_feature: HEFZJCU01D692V.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgaccctgggccagggaaccctagtcaccgtctcctcagcctccaccaacgggcccatcggtccttcccctcggccgccctcgctccaggacgcaccctccgaga

SEQ ID NO: 448062 - DNA, 504 bp, Homo sapiens; identical to SEQ ID NO: 445222
  misc_feature: HEFZJCU01EZ20P.9.33.C11.1.454.heavy.3.raw

SEQ ID NO: 448063 - DNA, 518 bp, Homo sapiens
  misc_feature: HEFZJCU01CO1FZ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggcccggggaaccctggtcgccgtctcctcagcctccaccaaggcccatcggtcttcccctggcaccctcctccaagagcacctctgggggcacagcggccctgggctgcctggtcaaggactacttccagacgtatca

SEQ ID NO: 448064 - DNA, 471 bp, Homo sapiens
  misc_feature: HEFZJCU01ELMDK.14.26.C04.1.454.heavy.3.raw
cgtctagtaccacgaccggtgctcgatttagtctagcgactttgggtttggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactattggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 448065 - DNA, 530 bp, Homo sapiens
  misc_feature: HEFZJCU01EFPLT.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaactgacgacactgccgtttattttgtacgagagcgtcgtctgtcagtggaattgactactggggccagggaaccctggtcaccgtctcctcagcctccaccaaggg

SEQ ID NO: 448066 - DNA, 478 bp, Homo sapiens
  misc_feature: HEFZJCU01DFFZI.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactactcgagacacg

SEQ ID NO: 448067 - DNA, 313 bp, Homo sapiens; identical to SEQ ID NO: 444518
  misc_feature: HEFZJCU01A66FV.7.10.A10.1.454.heavy.3.raw

SEQ ID NO: 448068 - DNA, 385 bp, Homo sapiens; identical to SEQ ID NO: 444438
  misc_feature: HEFZJCU01EE7OX.18.60.F05.1.454.heavy.3.raw

SEQ ID NO: 448069 - DNA, 498 bp, Homo sapiens
  misc_feature: HEFZJCU01DS8HU.53.8.A08.1.454.heavy.3.raw
cgcgtatacacacgaccggtgctcgatttagcatactctacaggggctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttggtggagtcggggggatctgtggtccggcctgggaggtccctgagactctcctgtacagcctccggattcagcttcgagaactatggcttgcactgggtccgccaggctccaggcaaggggctggagtgggtggcagttatttcatatgattcaagtattggatattacgcagactctgttaagggccgattcaccatctccagagacaattccaagaacaccctgtatctgcaattgagcagactcacagctgaggacacggctgtgtattactgtgtgaaagacgtttatgagagtagtggttttcg

SEQ ID NO: 448070 - DNA, 504 bp, Homo sapiens
  misc_feature: HEFZJCU01EE3DE.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtcctggggcccggaaccgggtc

SEQ ID NO: 448071 - DNA, 450 bp, Homo sapiens; identical to SEQ ID NO: 444890
  misc_feature: HEFZJCU01DT4SI.9.53.E09.1.454.heavy.3.raw

SEQ ID NO: 448072 - DNA, 510 bp, Homo sapiens
  misc_feature: HEFZJCU01AYY8X.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaaggcccatcggtcttcccctggcgccctgctccaggagcacctctgggggcacagcggccctgggctgcctggtcaaggactactcccatac

SEQ ID NO: 448073 - DNA, 500 bp, Homo sapiens
  misc_feature: HEFZJCU01EQFA8.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagtatttctatagaggtgacgtac

SEQ ID NO: 448074 - DNA, 533 bp, Homo sapiens
  misc_feature: HEFZJCU01EZD94.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttggggtttttttttcgttacgttacgggatt

SEQ ID NO: 448075 - DNA, 398 bp, Homo sapiens
  misc_feature: HEFZJCU01CO2SX.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgacaaatgaacagcctgagagccgaggactcggccacatattactgtgcgagaggtaattttgactggttattcctactactttgactacgtggggccagggcactccggtcaccgtctcctcagcctccaccaagggcccatcggtcttcccctggcaccctcctccaagagcacctctgggggcacagcggccctgggctgcctggtcaaggactacttcccatactcgta

SEQ ID NO: 448076 - DNA, 507 bp, Homo sapiens; identical to SEQ ID NO: 446637
  misc_feature: HEFZJCU01DXNGS.16.34.D01.1.454.heavy.3.raw

SEQ ID NO: 448077 - DNA, 491 bp, Homo sapiens
  misc_feature: HEFZJCU01EA31J.11.38.D05.1.454.heavy.3.raw
cgagagataccacgaccggtgctcgatttagtatctgatagttgggtctgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 448078 - DNA, 507 bp, Homo sapiens
  misc_feature: HEFZJCU01ENPXS.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactacgtggggccagggaaccctggtcaccgtctcctcagcctccaaccg

SEQ ID NO: 448079 - DNA, 511 bp, Homo sapiens
  misc_feature: HEFZJCU01ARP1I.48.53.E09.1.454.heavy.3.raw
agtatacatacacgaccggtgctcgatttagagagagtgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactt

SEQ ID NO: 448080 - DNA, 513 bp, Homo sapiens; identical to SEQ ID NO: 445134
  misc_feature: HEFZJCU01C4EWM.3.34.D01.1.454.heavy.3.raw

SEQ ID NO: 448081 - DNA, 379 bp, Homo sapiens; identical to SEQ ID NO: 444676
  misc_feature: HEFZJCU01CM2JE.47.77.G11.1.454.heavy.3.raw

SEQ ID NO: 448082 - DNA, 490 bp, Homo sapiens
  misc_feature: HEFZJCU01B91YB.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggccgccctgctccaggagcacctccgagagcacagcggccctgggctgcctggtcaaggactacttcctacgtgagct

SEQ ID NO: 448083 - DNA, 378 bp, Homo sapiens; identical to SEQ ID NO: 444463
  misc_feature: HEFZJCU01BVOP0.47.77.G11.1.454.heavy.3.raw

SEQ ID NO: 448084 - DNA, 359 bp, Homo sapiens
  misc_feature: HEFZJCU01E2Z64.47.38.D05.1.454.heavy.3.raw
agctcacgtacacgaccggtgctcgatttagtatctgatagttgggtttgggtgcccaagctgctggagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctcggcaccctcctccaacgagcacctctgggggcgacagcggccctgggctgcctggtcaaggactacttcctacgtgagct

SEQ ID NO: 448085 - DNA, 312 bp, Homo sapiens
  misc_feature: HEFZJCU01AUFVY.11.59.F04.1.454.heavy.3.raw
cgagagataccacgaccggtgctcgatttagtacacacacttagggattggggctgggagaggagcccagcactagaagtcggcggtgtctccattcggtgatcagcactgaacacagaggactcaccatggagtttgggctgaactgggttttcctcgtagctcttttaagaagtgattcatggagaaatagagagactgagtcctccaccaagggcccatcggtcttcccctggcaccctcctccaagagcacctctgggggcacagcggccctgggctgcctggtcaaggactacttccgtatctctcg

SEQ ID NO: 448086 - DNA, 515 bp, Homo sapiens
  misc_feature: HEFZJCU01CORUG.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagcgtgggtttctgtgttattctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctcag

SEQ ID NO: 448087 - DNA, 506 bp, Homo sapiens; identical to SEQ ID NO: 446520
  misc_feature: HEFZJCU01DB4S3.10.38.D05.1.454.heavy.3.raw

SEQ ID NO: 448088 - DNA, 513 bp, Homo sapiens
  misc_feature: HEFZJCU01B6LDZ.48.26.C04.1.454.heavy.3.raw
agtatacatacacgaccggtgctcgatttagtctagcgactttgggtttggggaccccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagagggttttactatggttcggggagtctccgacccagcaactggttcgaccccg

SEQ ID NO: 448089 - DNA, 323 bp, Homo sapiens
  misc_feature: HEFZJCU01BSLTM.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctccccaccctccaccaagggcccatcggtcttccccctggcaccctcctccaagagcacctctggggcacagcggccctgggctgcctggtcaaggactacttcccatactcgta

SEQ ID NO: 448090 - DNA, 517 bp, Homo sapiens
  misc_feature: HEFZJCU01DM6F5.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaactctcctgtgcagcctctggatacaccgtcagtagtaactccatgaactgggtccgccaggctccaggggaaggggctgggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtagtacgtcttttgatatcgtggggccaaggggaac

SEQ ID NO: 448091 - DNA, 492 bp, Homo sapiens
  misc_feature: HEFZJCU01CEJL6.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaatgtcagagccgacgacacggcccactattattgtgcgagagagagaacattaaatttggcgggctactacgagaacggattgggcgcctggggccaagggaccacggtcatcgtctcagcagcctccaccaagggcccatcggtcttccccctggcaccctcctccaagagcacctctgggggcacagcggccctgggctgcctggtcaaggactacttccgagtgcgtct

SEQ ID NO: 448092 - DNA, 497 bp, Homo sapiens
  misc_feature: HEFZJCU01D1E4S.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttctaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggcacggccgtatattactgtgacgaaagagttttggggaatgaacctctc

SEQ ID NO: 448093 - DNA, 484 bp, Homo sapiens
  misc_feature: HEFZJCU01CUU99.2.33.C11.1.454.heavy.3.raw
acgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctcggcgccctgctccaggagcacctccgagagcacagcggccctgggctgcctggtcaaggactacttcctgtcgagcgt

SEQ ID NO: 448094 - DNA, 493 bp, Homo sapiens
  misc_feature: HEFZJCU01CSTXF.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaat

SEQ ID NO: 448095 - DNA, 470 bp, Homo sapiens
  misc_feature: HEFZJCU01BE45V.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaaggcccatcggtcttcccctcggcgccctgctccaggagcacctccgagagcacagcggccctgggctgcctggtcaaggactacttccctacagtgct

SEQ ID NO: 448096 - DNA, 391 bp, Homo sapiens
  misc_feature: HEFZJCU01C02JW.49.42.D09.1.454.heavy.3.raw
agtcgagagacacgaccggtgctcgatttagacacatacgcagggaaagggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttccttctcgact

SEQ ID NO: 448097 - DNA, 477 bp, Homo sapiens; identical to SEQ ID NO: 444659
  misc_feature: HEFZJCU01A27WM.16.10.A10.1.454.heavy.3.raw

SEQ ID NO: 448098 - DNA, 505 bp, Homo sapiens; identical to SEQ ID NO: 447570
  misc_feature: HEFZJCU01D6I5Z.47.81.H04.1.454.heavy.3.raw

SEQ ID NO: 448099 - DNA, 503 bp, Homo sapiens
  misc_feature: HEFZJCU01CYFW4.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtatttattgtacattaggacactatacg

SEQ ID NO: 448100 - DNA, 396 bp, Homo sapiens; identical to SEQ ID NO: 444469
  misc_feature: HEFZJCU01EZFJO.47.46.E02.1.454.heavy.3.raw

SEQ ID NO: 448101 - DNA, 515 bp, Homo sapiens
  misc_feature: HEFZJCU01EFGHY.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggattacttccgagtacg

SEQ ID NO: 448102 - DNA, 489 bp, Homo sapiens; identical to SEQ ID NO: 444791
  misc_feature: HEFZJCU01DS6ZL.47.85.H08.1.454.heavy.3.raw

SEQ ID NO: 448103 - DNA, 400 bp, Homo sapiens
  misc_feature: HEFZJCU01AGY04.53.24.C02.1.454.heavy.3.raw
cgcgtatacacacgaccggtgctcgatttagtacagatcgttagggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 448104 - DNA, 525 bp, Homo sapiens
  misc_feature: HEFZJCU01CPRFB.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctcccaccctccaccaagggcccatcggtcttcccctggcaccctcctccaagagcacctctgggggcacagcggccctgggctgcctggtcaaggactacttcccatactcgta

SEQ ID NO: 448105 - DNA, 478 bp, Homo sapiens
  misc_feature: HEFZJCU01EI8K4.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagaga

SEQ ID NO: 448106 - DNA, 481 bp, Homo sapiens
  misc_feature: HEFZJCU01EAVNR.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccaggggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 448107 - DNA, 481 bp, Homo sapiens
  misc_feature: HEFZJCU01B8V3U.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggactagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 448108 - DNA, 510 bp, Homo sapiens
  misc_feature: HEFZJCU01D05SV.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcctggg

SEQ ID NO: 448109 - DNA, 376 bp, Homo sapiens
  misc_feature: HEFZJCU01ALUF1.49.72.G06.1.454.heavy.3.raw
agtcgagagacacgaccggtgctcgatttagctacgactgcaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 448110 - DNA, 513 bp, Homo sapiens
  misc_feature: HEFZJCU01A3US8.11.13.B02.1.454.heavy.3.raw
  modified_base (497)..(497): a, c, t, g, unknown or other
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctctcgtcgngcggcgtcggcgagac

SEQ ID NO: 448111 - DNA, 459 bp, Homo sapiens
  misc_feature: HEFZJCU01ELBXN.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgcccaagatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 448112 - DNA, 512 bp, Homo sapiens
  misc_feature: HEFZJCU01BC6IM.48.2.A02.1.454.heavy.3.raw
agtatacatacacgaccggtgctcgatttagactcatctacagggggaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtggaaattattatgatgcatttgatt

SEQ ID NO: 448113 - DNA, 493 bp, Homo sapiens
  misc_feature: HEFZJCU01DYJTG.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctggggctgcctggtcaaggactacttccgagtgcgtct

SEQ ID NO: 448114 - DNA, 492 bp, Homo sapiens; identical to SEQ ID NO: 447005
  misc_feature: HEFZJCU01BOLA1.53.26.C04.1.454.heavy.3.raw

SEQ ID NO: 448115 - DNA, 511 bp, Homo sapiens
  misc_feature: HEFZJCU01APRK8.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactacttcccatac

SEQ ID NO: 448116 - DNA, 515 bp, Homo sapiens
  misc_feature: HEFZJCU01DS86F.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaaggccatcggtctccctgcgcctgctcagagcacctccgagagcacagcggccctggc

SEQ ID NO: 448117 - DNA, 510 bp, Homo sapiens; identical to SEQ ID NO: 445542
  misc_feature: HEFZJCU01A86WJ.16.21.B10.1.454.heavy.3.raw

SEQ ID NO: 448118 - DNA, 463 bp, Homo sapiens
  misc_feature: HEFZJCU01DPC5R.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 448119 - DNA, 391 bp, Homo sapiens; identical to SEQ ID NO: 444514
  misc_feature: HEFZJCU01CUCCY.12.24.C02.1.454.heavy.3.raw

SEQ ID NO: 448120 - DNA, 525 bp, Homo sapiens
  misc_feature: HEFZJCU01B0V5U.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccg

SEQ ID NO: 448121 - DNA, 519 bp, Homo sapiens
  misc_feature: HEFZJCU01EZTHI.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcacagcggcccgtgggctgcctggtcaaggactacttccgagtagtacac

SEQ ID NO: 448122 - DNA, 528 bp, Homo sapiens
  misc_feature: HEFZJCU01EOT8G.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgactcttgatagtagtggttatcctgaatactggggccagggaaccctggtgaccgtctcctcagcctccaccaagggcccatcggtcttcccctggcgccctgctccaggagcacctccgagagcacacgcggcccctgggcc

SEQ ID NO: 448123 - DNA, 385 bp, Homo sapiens
  misc_feature: HEFZJCU01CWCIX.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagaggactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 448124 - DNA, 526 bp, Homo sapiens
  misc_feature: HEFZJCU01AUNMO.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgcgagggcggttacccctctggttccttcgacagttatggtagtggacgtcgtggggccgtagggacgtacggtcaccgtctcctcacgcctccaccgaacgggcccagtcggttccttcccccgtggccta

SEQ ID NO: 448125 - DNA, 512 bp, Homo sapiens
  misc_feature: HEFZJCU01CFEDN.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggcca

SEQ ID NO: 448126 - DNA, 488 bp, Homo sapiens
  misc_feature: HEFZJCU01BQBDE.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcttggggccgggaaccctggtcaccgtctcttcagcttccaccaagggcccatcggtcttcccctggcgccctgctccaggagcacctctgggggcacagcggccctgggctgcctggtcaaggactacttcctacgtgagct

SEQ ID NO: 448127 - DNA, 486 bp, Homo sapiens
  misc_feature: HEFZJCU01BDS76.49.8.A08.1.454.heavy.3.raw
agtcgagagacacgaccggtgctcgatttagcatactctacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttaatcacggaggacg

SEQ ID NO: 448128 - DNA, 374 bp, Homo sapiens; identical to SEQ ID NO: 444640
  misc_feature: HEFZJCU01BWY16.7.37.D04.1.454.heavy.3.raw

SEQ ID NO: 448129 - DNA, 375 bp, Homo sapiens
  misc_feature: HEFZJCU01A1CYA.49.45.E01.1.454.heavy.3.raw
agtcgagagacacgaccggtgctcgatttagtgagtcagtaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 448130 - DNA, 496 bp, Homo sapiens; identical to SEQ ID NO: 444697
  misc_feature: HEFZJCU01CV9N1.16.37.D04.1.454.heavy.3.raw

SEQ ID NO: 448131 - DNA, 481 bp, Homo sapiens
  misc_feature: HEFZJCU01CMRIR.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggcctgggctgcctggtcaaggactacttcctacgtgagct

SEQ ID NO: 448132 - DNA, 489 bp, Homo sapiens; identical to SEQ ID NO: 444791
  misc_feature: HEFZJCU01EDX9R.47.85.H08.1.454.heavy.3.raw

SEQ ID NO: 448133 - DNA, 327 bp, Homo sapiens; identical to SEQ ID NO: 444439
  misc_feature: HEFZJCU01AWUSZ.40.20.B09.1.454.heavy.3.raw

SEQ ID NO: 448134 - DNA, 400 bp, Homo sapiens; identical to SEQ ID NO: 444452
  misc_feature: HEFZJCU01A5QSO.47.24.C02.1.454.heavy.3.raw

SEQ ID NO: 448135 - DNA, 508 bp, Homo sapiens; identical to SEQ ID NO: 446002
  misc_feature: HEFZJCU01C9BAA.9.78.H01.1.454.heavy.3.raw

SEQ ID NO: 448136 - DNA, 477 bp, Homo sapiens
  misc_feature: HEFZJCU01EAKAP.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaatgaacagcctgagagctgaagacacggctgtgttttactgtgcgagagaga

SEQ ID NO: 448137 - DNA, 507 bp, Homo sapiens
  misc_feature: HEFZJCU01BXNV5.48.44.D11.1.454.heavy.3.raw
agtatacatacacgaccggtgctcgatttagcgcagtacgaagggaggcttggtccagcctgggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 448138 - DNA, 479 bp, Homo sapiens
  misc_feature: HEFZJCU01DX9Y1.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacgtcg

SEQ ID NO: 448139 - DNA, 312 bp, Homo sapiens
  misc_feature: HEFZJCU01D78UH.11.59.F04.1.454.heavy.3.raw
cgagagataccacgaccggtgctcgatttagtacacacacttagggattggggctgggagaggagcccagcactagaagtcggcggtgtctccattcggtgatcagcactgaacacagaggactcaccatggagtttgggctgaactgggttttcctcgtagctcttttaagaagtgattcatggagaaatagagagactgagtcctccaccaagggcccatcggtcttccccctggcaccctcctccaagagcacctctggggcacagcggccctgggctgcctggtcaaggactacttccgtatctctcg

SEQ ID NO: 448140 - DNA, 482 bp, Homo sapiens; identical to SEQ ID NO: 444503
  misc_feature: HEFZJCU01BKBYL.7.10.A10.1.454.heavy.3.raw

SEQ ID NO: 448141 - DNA, 522 bp, Homo sapiens
  misc_feature: HEFZJCU01ES5PW.12.40.D07.1.454.heavy.3.raw
atacgacgtacacgaccggtgctcgatttagtgatagagcgtaacaacagaggactcaccatggagtttgggctgagcgtggtttcgtcgtaggcgtctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtctccccctggcg

SEQ ID NO: 448142 - DNA, 514 bp, Homo sapiens
  misc_feature: HEFZJCU01B3VPR.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcaccg

SEQ ID NO: 448143 - DNA, 527 bp, Homo sapiens
  misc_feature: HEFZJCU01DCALS.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctaaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgaatgacacaggactctattattgtaccactaagagtcccacgaagactgtgggaaggactgctggggccg

SEQ ID NO: 448144 - DNA, 526 bp, Homo sapiens
  misc_feature: HEFZJCU01D5F4C.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcgggggctattatggttcgggagatcccagtggttttgattatatggggccagggggacagcggtcaccgtctcttcagt

SEQ ID NO: 448145 - DNA, 488 bp, Homo sapiens
  misc_feature: HEFZJCU01CV64L.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctgggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 448146 - DNA, 496 bp, Homo sapiens; identical to SEQ ID NO: 444697
  misc_feature: HEFZJCU01CI8GU.16.37.D04.1.454.heavy.3.raw

SEQ ID NO: 448147 - DNA, 477 bp, Homo sapiens; identical to SEQ ID NO: 444659
  misc_feature: HEFZJCU01CGJHT.16.10.A10.1.454.heavy.3.raw

SEQ ID NO: 448148 - DNA, 518 bp, Homo sapiens; identical to SEQ ID NO: 447436
  misc_feature: HEFZJCU01ACUQR.13.76.G10.1.454.heavy.3.raw

SEQ ID NO: 448149 - DNA, 434 bp, Homo sapiens
  misc_feature: HEFZJCU01D1C4K.51.38.D05.1.454.heavy.3.raw
cgatcgtatacacgaccggtgctcgatttagtatctgatagttgggtttggggggaagaggaagactgacggtccccccaggagttcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 448150 - DNA, 312 bp, Homo sapiens
  misc_feature: HEFZJCU01DKK0N.49.76.G10.1.454.heavy.3.raw
agtcgagagacacgaccggtgctcgatttagtcactcatacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctgggggcacagcggccctgggctgcctggtcaaggactacttcctctctcgact

SEQ ID NO: 448151 - DNA, 519 bp, Homo sapiens; identical to SEQ ID NO: 445330
  misc_feature: HEFZJCU01CSV93.7.78.H01.1.454.heavy.3.raw

SEQ ID NO: 448152 - DNA, 518 bp, Homo sapiens; identical to SEQ ID NO: 445220
  misc_feature: HEFZJCU01CO5A4.9.70.G04.1.454.heavy.3.raw

SEQ ID NO: 448153 - DNA, 496 bp, Homo sapiens
  misc_feature: HEFZJCU01BP6PR.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttaggttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgt

SEQ ID NO: 448154 - DNA, 519 bp, Homo sapiens
  misc_feature: HEFZJCU01CODPU.9.34.D01.1.454.heavy.3.raw
  modified_base (404)..(404): a, c, t, g, unknown or other
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtcncctcagcctccaccaagggcccatcggtcttccccctggcaccctcctccaagagcacctctgggggcacagcggccctgggctgcctggtcaaggactacttccagacgtatca

SEQ ID NO: 448155 - DNA, 389 bp, Homo sapiens
  misc_feature: HEFZJCU01BOP95.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgcctgctccaggagcacctccgagagcacagcggccctgggctgcctggtcaaggactacttccgagtagtaca

SEQ ID NO: 448156 - DNA, 525 bp, Homo sapiens
  misc_feature: HEFZJCU01DQI5L.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctggggcacagcggcctgggctg

SEQ ID NO: 448157 - DNA, 515 bp, Homo sapiens
  misc_feature: HEFZJCU01CZIL4.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtcttccccctggcgccctcgctccaggagcacctccgacgagcacagcggccctggg

SEQ ID NO: 448158 - DNA, 514 bp, Homo sapiens
  misc_feature: HEFZJCU01CGGPT.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacaagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggccc

SEQ ID NO: 448159 - DNA, 480 bp, Homo sapiens
  misc_feature: HEFZJCU01EJEKR.51.86.H09.1.454.heavy.3.raw
cgatcgtatacacgaccggtgctcgatttagtgctatagacttgggtttggggggtttggggggaagaggaagactgacggtcctcccaggagttcaggtgctgggcaccgtgggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaacttttgatatctggggccacgggacaatggtcaccgtctcttcagcttccaccaagggcccatcggtcttccccctggcgccctgctccaggagcacctctgggggcacagcggccctgggctgcctggtcaggactacttcctcgtagcact

SEQ ID NO: 448160 - DNA, 379 bp, Homo sapiens; identical to SEQ ID NO: 444450
  misc_feature: HEFZJCU01EIN8Y.47.77.G11.1.454.heavy.3.raw

SEQ ID NO: 448161 - DNA, 523 bp, Homo sapiens
  misc_feature: HEFZJCU01ALGQQ.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggccccatccgtcttccccctggcgccctgctccaggagcacctccgagagcacagcggccctgggctgcctggtcaaggactacttcctacg

SEQ ID NO: 448162 - DNA, 468 bp, Homo sapiens
  misc_feature: HEFZJCU01DEYM1.49.82.H05.1.454.heavy.3.raw
agtcgagagacacgaccggtgctcgatttagtcgagctctctcgcgggcacgaccggtgctcgatttagtcgagctctctcgcgggcacgaccggtgctcgatttagtcgatagtgagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 448163 - DNA, 482 bp, Homo sapiens; identical to SEQ ID NO: 444503
  misc_feature: HEFZJCU01CTAPH.7.10.A10.1.454.heavy.3.raw

SEQ ID NO: 448164 - DNA, 514 bp, Homo sapiens
  misc_feature: HEFZJCU01D7K74.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgtct

SEQ ID NO: 448165 - DNA, 404 bp, Homo sapiens
  misc_feature: HEFZJCU01DQP7G.51.52.E08.1.454.heavy.3.raw
cgatcgtatacacgaccggtgctcgatttagtcgagctctcagagagaaagggggggggctatttataaacccaaaaggacatggccatgcagcgggtagggacaatacagacagatatcagcctgaagtggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccggatttccccaggcctggcgcctccaccaagggcccatcggtcttccccctggcaccctcctccaagagcacctctgggggcacagcggccctgggctgcctggtcaaggactacttcctcgtagcact

SEQ ID NO: 448166 - DNA, 524 bp, Homo sapiens; identical to SEQ ID NO: 445902
  misc_feature: HEFZJCU01ASQN9.9.78.H01.1.454.heavy.3.raw

SEQ ID NO: 448167 - DNA, 450 bp, Homo sapiens; identical to SEQ ID NO: 444893
  misc_feature: HEFZJCU01D3PR9.53.57.F02.1.454.heavy.3.raw

SEQ ID NO: 448168 - DNA, 485 bp, Homo sapiens
  misc_feature: HEFZJCU01BX4BE.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgcctgctccaggagcacctccgagagcacagcggccctgggctgcctggtcaaggactactcctacgtgagct

SEQ ID NO: 448169 - DNA, 499 bp, Homo sapiens
  misc_feature: HEFZJCU01D2DUJ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgtcgtaggctctttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggaacacggctgtgtattactgtgcgaaagtatttctatagaggtgaacgtacgggggcttc

SEQ ID NO: 448170 - DNA, 536 bp, Homo sapiens
  misc_feature: HEFZJCU01AI2L4.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggggagccctggtcaccg

SEQ ID NO: 448171 - DNA, 518 bp, Homo sapiens; identical to SEQ ID NO: 445423
  misc_feature: HEFZJCU01ASGQU.7.78.H01.1.454.heavy.3.raw

SEQ ID NO: 448172 - DNA, 402 bp, Homo sapiens
  misc_feature: HEFZJCU01CW9ZH.52.66.F11.1.454.heavy.3.raw
cgcagtacgacacgaccggtgctcgatttagtcacgcgagaaggggctggagtgggtctcaatgatcagtgatgatggacgtagcacaaaatacgccgactccgtgaagggccggtgcaccatctccagagacaattcgaaggacactctatacctgcaactcaacagactgacacccgcggacacggccgtctattactgtgtaaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctatacgatcg

SEQ ID NO: 448173 - DNA, 528 bp, Homo sapiens
  misc_feature: HEFZJCU01CIPC6.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttccccctcggtcgccctcgctccaggagcacctccgacgacgcacagcggcccgtcgggcgtgcctggtcaacggacgtacttcct

SEQ ID NO: 448174 - DNA, 505 bp, Homo sapiens
  misc_feature: HEFZJCU01ESG4Z.48.49.E05.1.454.heavy.3.raw
agtatacatacacgaccggtgctcgatttagagcgactagcaacacacaaaggggaggtctcagagaggagccttagccctggactccaaggcctttccacttggtgatcagcactgagcacagaggactcaccatggaattggggctgagcgtggttttccgttgttaggctattttagaaggtgtccagtgtgaggtgcagctggtggagtctgggggaggcttggtccagccgggggggtccctgagactctcctgtgcagcctctggactcacctttagtacctattggatgacctgggtccgccaatctccagggagggggctggagtgggtggccaacataaagggagatggaagtaagacatactatgcggattctgtgaagggccgattcaccatctccagagacaacgccaaggagtcactgtatctgcagatgaacagcctgagagccgaggacgcggctgtgtattactgtgcgagagatgtgaatccctttga

SEQ ID NO: 448175 - DNA, 400 bp, Homo sapiens; identical to SEQ ID NO: 444452
  misc_feature: HEFZJCU01DTYK1.47.24.C02.1.454.heavy.3.raw

SEQ ID NO: 448176 - DNA, 482 bp, Homo sapiens; identical to SEQ ID NO: 444503
  misc_feature: HEFZJCU01EW76C.7.10.A10.1.454.heavy.3.raw

SEQ ID NO: 448177 - DNA, 409 bp, Homo sapiens; identical to SEQ ID NO: 444519
  misc_feature: HEFZJCU01BUOPT.3.41.D08.1.454.heavy.3.raw

SEQ ID NO: 448178 - DNA, 495 bp, Homo sapiens
  misc_feature: HEFZJCU01BFOJ0.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtgctacgagtactggtacttcgatctctgggccgtggcaccctgctgactgtctcctcagcctccaccaagggcccatcggtcttcccctggcgccctgctccaggagcacctccgagagcacagcggccctgggctgcctggtcaaggactac

SEQ ID NO: 448179 - DNA, 521 bp, Homo sapiens; identical to SEQ ID NO: 445317
  misc_feature: HEFZJCU01BNOO8.12.40.D07.1.454.heavy.3.raw

SEQ ID NO: 448180 - DNA, 398 bp, Homo sapiens
  misc_feature: HEFZJCU01DURNG.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatagttactgtgcgagaggaattttgactggttattcctactactttgactactggggccagggcactccggtcaccgtctcctcagcctccaccaagggcccatcggtcttccccctggcaccctcctccaagagcacctctgggggtcacagcggccctgggctgcctggtcaaggactacttcccatactcgta

SEQ ID NO: 448181 - DNA, 395 bp, Homo sapiens; identical to SEQ ID NO: 447960
  misc_feature: HEFZJCU01CAYBX.10.42.D09.1.454.heavy.3.raw

SEQ ID NO: 448182 - DNA, 504 bp, Homo sapiens
  misc_feature: HEFZJCU01CBFB7.7.28.C06.1.454.heavy.3.raw
  modified_base (475)..(475): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttnatctgaatctgggccagggaaccctggcg

SEQ ID NO: 448183 - DNA, 373 bp, Homo sapiens
  misc_feature: HEFZJCU01CDSSD.49.41.D08.1.454.heavy.3.raw
agtcgagagacacgaccggtgctcgatttagtcacgcgagaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 448184 - DNA, 449 bp, Homo sapiens; identical to SEQ ID NO: 444589
  misc_feature: HEFZJCU01CVUN5.53.57.F02.1.454.heavy.3.raw

SEQ ID NO: 448185 - DNA, 407 bp, Homo sapiens
  misc_feature: HEFZJCU01CDSKL.11.70.G04.1.454.heavy.3.raw
cgagagataccacgaccggtgctcgatttagtgtagtgtgaagggaaaggggttgtaattggtgtttccagtgatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 448186 - DNA, 511 bp, Homo sapiens
  misc_feature: HEFZJCU01EWOCL.21.34.D01.1.454.heavy.3.raw
tcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaagtatgtggactctgtgaagggccgattcaccatcttcagagacaacgccaagaactcactttatctgcaaatgaatagcctgagagtcgaagacacggctgtgtattactgtgcgagagatagcgaggaggtggagcagctcgtcgatttgtactacatggacgtctggggcaaagggaccacggtcaccgtctcctcagcctccaccaagggcccatcggtcttcccctggcaccctcctccaagagcacctctgggggcacagcggccctgggctgcctggtcaaggactacttcccgagcgacga

SEQ ID NO: 448187 - DNA, 481 bp, Homo sapiens
  misc_feature: HEFZJCU01CODC9.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcacctcctccaagagcacctctgggggcacagcggccctgggctgcctggtcaaggactacttcctagagacacg

SEQ ID NO: 448188 - DNA, 520 bp, Homo sapiens; identical to SEQ ID NO: 446725
  misc_feature: HEFZJCU01AI57P.12.86.H09.1.454.heavy.3.raw

SEQ ID NO: 448189 - DNA, 526 bp, Homo sapiens
  misc_feature: HEFZJCU01CU3LC.16.27.C05.1.454.heavy.3.raw
  modified_base (519)..(519): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactgggggccggggagccccggtnatcgtct

SEQ ID NO: 448190 - DNA, 490 bp, Homo sapiens; identical to SEQ ID NO: 445139
  misc_feature: HEFZJCU01BGSL8.12.75.G09.1.454.heavy.3.raw

SEQ ID NO: 448191 - DNA, 508 bp, Homo sapiens
  misc_feature: HEFZJCU01EZ3JC.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 448192 - DNA, 483 bp, Homo sapiens; identical to SEQ ID NO: 444924
  misc_feature: HEFZJCU01DREF3.10.35.D02.1.454.heavy.3.raw

SEQ ID NO: 448193 - DNA, 431 bp, Homo sapiens
  misc_feature: HEFZJCU01CCEZ8.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaggactacttccgtatctctcg

SEQ ID NO: 448194 - DNA, 498 bp, Homo sapiens
  misc_feature: HEFZJCU01DW0GG.11.57.F02.1.454.heavy.3.raw
cgagagataccacgaccggtgctcgatttagctcgatatagttgggtttgggggctctcagataggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagagcccctacggtgtacg

SEQ ID NO: 448195 - DNA, 352 bp, Homo sapiens
  misc_feature: HEFZJCU01A88UP.2.20.B09.1.454.heavy.3.raw
acgctcgacacacgaccggtgctcgatttagtgtagtgtgaagggccggttcaccatctccagagacaattccaagaacacgctgtatctgcaaatgaacagcctgagagtcgaggacacggccgtatatcactgtgcgaaactgttaggtggacttgggtattacgatctttcgactggttctaaaaggactactacggcatggacgtctggggcctagggaccacggtcaccgtctcctcagcctccaccaagggcccatcggtcttccccctggcaccctcctccaagagcacctctgggggcacagcggcctgggctgcctggtcaaggactacttcctgtcgagcgt

SEQ ID NO: 448196 - DNA, 396 bp, Homo sapiens; identical to SEQ ID NO: 445818
  misc_feature: HEFZJCU01BF4BN.16.68.G02.1.454.heavy.3.raw

SEQ ID NO: 448197 - DNA, 508 bp, Homo sapiens; identical to SEQ ID NO: 445594
  misc_feature: HEFZJCU01EFYY6.17.25.C03.1.454.heavy.3.raw

SEQ ID NO: 448198 - DNA, 518 bp, Homo sapiens
  misc_feature: HEFZJCU01APQTN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggccacgaacgttactacgctatggacgtctggggccaagggaccg

SEQ ID NO: 448199 - DNA, 517 bp, Homo sapiens; identical to SEQ ID NO: 446039
  misc_feature: HEFZJCU01ARRU6.9.70.G04.1.454.heavy.3.raw

SEQ ID NO: 448200 - DNA, 512 bp, Homo sapiens
  misc_feature: HEFZJCU01DN0T4.48.57.F02.1.454.heavy.3.raw
agtatacatacacgaccggtgctcgatttagctcgatatagttgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaagggggagcagctcgtccatccacttcgactcctggggccagggaaccctggtcaccgtctcctcagcctccaccaaggcccatcggtcttccccctggccaccctcctccaagagcacctctc

SEQ ID NO: 448201 - DNA, 508 bp, Homo sapiens
  misc_feature: HEFZJCU01BERNQ.19.15.B04.1.454.heavy.3.raw
tactctcgtgcacgaccggtgctcgatttagacagtatatatccgcggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcggccgtattacaaggaaagctaacagttacagtacagaatacggcgcgtctgtgaaaggaaggttcaccatctcaagagatgattcaaagaactcactgtatctgcaaatgaacagcctgaaaaccgaggacacggccgtgtattattgtggtagacaaaagagtggatgtggtgtag

SEQ ID NO: 448202 - DNA, 498 bp, Homo sapiens
  misc_feature: HEFZJCU01DLGI1.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccgaggtgcccagccggccccttacg

SEQ ID NO: 448203 - DNA, 491 bp, Homo sapiens; identical to SEQ ID NO: 446104
  misc_feature: HEFZJCU01A61YY.3.34.D01.1.454.heavy.3.raw

SEQ ID NO: 448204 - DNA, 496 bp, Homo sapiens
  misc_feature: HEFZJCU01DQD1C.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgcttttgatgcctttgatatgtggggcagggacaatggt

SEQ ID NO: 448205 - DNA, 534 bp, Homo sapiens
  misc_feature: HEFZJCU01CYRWN.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggccaagggaccacggtcaccgtctcctcagcctccaccaagggcccatcggtcttcccctggcgccctgctccaggagcacctccgagagcacagcc

SEQ ID NO: 448206 - DNA, 520 bp, Homo sapiens
  misc_feature: HEFZJCU01AGSWH.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccccgtggggccagggaaccctggtccaccgtctcctca

SEQ ID NO: 448207 - DNA, 506 bp, Homo sapiens
  misc_feature: HEFZJCU01EX2FR.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgccctgctccaggagcacctctgggggcacagcggccctgggctgcctggtcaaggactacttcctcgtact

SEQ ID NO: 448208 - DNA, 493 bp, Homo sapiens
  misc_feature: HEFZJCU01A1I61.53.27.C05.1.454.heavy.3.raw
cgcgtatacacacgaccggtgctcgatttagacgcgatcgaagggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccggccc

SEQ ID NO: 448209 - DNA, 483 bp, Homo sapiens; identical to SEQ ID NO: 444924
  misc_feature: HEFZJCU01BSOBP.10.35.D02.1.454.heavy.3.raw

SEQ ID NO: 448210 - DNA, 406 bp, Homo sapiens
  misc_feature: HEFZJCU01DRBO8.48.72.G06.1.454.heavy.3.raw
agtatacatacacgaccggtgctcgatttagctacgactgcaagggaaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 448211 - DNA, 379 bp, Homo sapiens; identical to SEQ ID NO: 444450
  misc_feature: HEFZJCU01BUNY3.47.77.G11.1.454.heavy.3.raw

SEQ ID NO: 448212 - DNA, 480 bp, Homo sapiens; identical to SEQ ID NO: 446171
  misc_feature: HEFZJCU01CQC9G.22.36.D03.1.454.heavy.3.raw

SEQ ID NO: 448213 - DNA, 374 bp, Homo sapiens; identical to SEQ ID NO: 444640
  misc_feature: HEFZJCU01CH7RO.7.37.D04.1.454.heavy.3.raw

SEQ ID NO: 448214 - DNA, 493 bp, Homo sapiens
  misc_feature: HEFZJCU01D8WBM.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggccgccctgctccaggagcacctccgagagcacagcggccctgggctgcctggtcaaggactacttcccacgacgagta

SEQ ID NO: 448215 - DNA, 400 bp, Homo sapiens; identical to SEQ ID NO: 444452
  misc_feature: HEFZJCU01ETVT4.47.24.C02.1.454.heavy.3.raw

SEQ ID NO: 448216 - DNA, 310 bp, Homo sapiens; identical to SEQ ID NO: 444473
  misc_feature: HEFZJCU01AYWQ2.18.53.E09.1.454.heavy.3.raw

SEQ ID NO: 448217 - DNA, 498 bp, Homo sapiens
  misc_feature: HEFZJCU01DCUNR.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccgaagggacaatggtcaccgtct

SEQ ID NO: 448218 - DNA, 356 bp, Homo sapiens; identical to SEQ ID NO: 444460
  misc_feature: HEFZJCU01DZ81T.47.38.D05.1.454.heavy.3.raw

SEQ ID NO: 448219 - DNA, 396 bp, Homo sapiens; identical to SEQ ID NO: 444469
  misc_feature: HEFZJCU01EX7QO.47.46.E02.1.454.heavy.3.raw

SEQ ID NO: 448220 - DNA, 516 bp, Homo sapiens
  misc_feature: HEFZJCU01CXKIG.11.12.B01.1.454.heavy.3.raw
cgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatggacgtcgtggggcc

SEQ ID NO: 448221 - DNA, 496 bp, Homo sapiens; identical to SEQ ID NO: 444697
  misc_feature: HEFZJCU01BOYFC.16.37.D04.1.454.heavy.3.raw

SEQ ID NO: 448222 - DNA, 508 bp, Homo sapiens
  misc_feature: HEFZJCU01AXM9C.49.5.A05.1.454.heavy.3.raw
agtcgagagacacgaccggtgctcgatttagatagatagacaggggctgggagacgagcccagcactggaagtcgccggtgtttccattcggtgatcatcactgaacacagaggactcaccatggagtttgggctgagcgtggtttcgtcgttaggctctttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactacgtggggccac

SEQ ID NO: 448223 - DNA, 506 bp, Homo sapiens
  misc_feature: HEFZJCU01EX0F0.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 448224 - DNA, 510 bp, Homo sapiens
  misc_feature: HEFZJCU01CFYHD.51.86.H09.1.454.heavy.3.raw
cgatcgtatacacgaccggtgctcgatttagtgctatagacttgggtttgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaacttttgatatctggggccacgggacaatggtcaccgtctcttcagcttccaccaagggcccatcggtcttcccctggcgccctgctccaggagcacctctgggggcacagcggccctgggctgcctggtcaaggactacttcctcg

SEQ ID NO: 448225 - DNA, 463 bp, Homo sapiens
  misc_feature: HEFZJCU01DJVKM.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgaggta

SEQ ID NO: 448226 - DNA, 488 bp, Homo sapiens
  misc_feature: HEFZJCU01B2X0U.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttccatactcgta

SEQ ID NO: 448227 - DNA, 392 bp, Homo sapiens; identical to SEQ ID NO: 444682
  misc_feature: HEFZJCU01EATI5.16.70.G04.1.454.heavy.3.raw

SEQ ID NO: 448228 - DNA, 531 bp, Homo sapiens
  misc_feature: HEFZJCU01BAG5W.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcggacccctgggggcccaggggaaccctggtcaccgtctcctcagcctccacccg

SEQ ID NO: 448229 - DNA, 520 bp, Homo sapiens
  misc_feature: HEFZJCU01BDWLF.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctcggcgccctgctccaggagcacctccgagagcacagcggccc

SEQ ID NO: 448230 - DNA, 498 bp, Homo sapiens
  misc_feature: HEFZJCU01EWQRG.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggctttttgatgcctttgatatgtgggccagggacaagtggtcaccgtctc

SEQ ID NO: 448231 - DNA, 492 bp, Homo sapiens
  misc_feature: HEFZJCU01CP529.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggccacctcctccaagagcacctctgggggcacagcggccctgggctgcctggtcaaggactacttccgagtgcgtct

SEQ ID NO: 448232 - DNA, 537 bp, Homo sapiens; identical to SEQ ID NO: 445697
  misc_feature: HEFZJCU01D1CF8.14.57.F02.1.454.heavy.3.raw

SEQ ID NO: 448233 - DNA, 491 bp, Homo sapiens; identical to SEQ ID NO: 446104
  misc_feature: HEFZJCU01A1CJT.3.34.D01.1.454.heavy.3.raw

SEQ ID NO: 448234 - DNA, 490 bp, Homo sapiens; identical to SEQ ID NO: 446494
  misc_feature: HEFZJCU01APHK3.11.13.B02.1.454.heavy.3.raw

SEQ ID NO: 448235 - DNA, 508 bp, Homo sapiens
  misc_feature: HEFZJCU01APLK7.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggcgccctgctccaggacg

SEQ ID NO: 448236 - DNA, 400 bp, Homo sapiens; identical to SEQ ID NO: 444452
  misc_feature: HEFZJCU01AS27O.47.24.C02.1.454.heavy.3.raw

SEQ ID NO: 448237 - DNA, 518 bp, Homo sapiens
  misc_feature: HEFZJCU01D2GO9.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtcgtggggccaggggaccaa

SEQ ID NO: 448238 - DNA, 511 bp, Homo sapiens
  misc_feature: HEFZJCU01B6OWR.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 448239 - DNA, 488 bp, Homo sapiens
  misc_feature: HEFZJCU01EQ5IX.12.53.E09.1.454.heavy.3.raw
atacgacgtacacgaccggtgctcgatttagagagagtgtgttgggtttggggggtccctgagactctcctgtgtagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaaggactacttcctacgtcgtat

SEQ ID NO: 448240 - DNA, 379 bp, Homo sapiens; identical to SEQ ID NO: 444450
  misc_feature: HEFZJCU01A9OIW.47.77.G11.1.454.heavy.3.raw

SEQ ID NO: 448241 - DNA, 481 bp, Homo sapiens; identical to SEQ ID NO: 446362
  misc_feature: HEFZJCU01EI5ON.19.67.G01.1.454.heavy.3.raw

SEQ ID NO: 448242 - DNA, 532 bp, Homo sapiens
  misc_feature: HEFZJCU01B94N9.48.33.C11.1.454.heavy.3.raw
agtatacatacacgaccggtgctcgatttagagtgagctcgttgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgtcccg

SEQ ID NO: 448243 - DNA, 396 bp, Homo sapiens
  misc_feature: HEFZJCU01B9WIW.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcacacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 448244 - DNA, 517 bp, Homo sapiens; identical to SEQ ID NO: 446039
  misc_feature: HEFZJCU01ECXTG.9.70.G04.1.454.heavy.3.raw

SEQ ID NO: 448245 - DNA, 493 bp, Homo sapiens; identical to SEQ ID NO: 448113
  misc_feature: HEFZJCU01CKWCD.3.34.D01.1.454.heavy.3.raw

SEQ ID NO: 448246 - DNA, 423 bp, Homo sapiens; identical to SEQ ID NO: 444772
  misc_feature: HEFZJCU01D2GC6.16.78.H01.1.454.heavy.3.raw

SEQ ID NO: 448247 - DNA, 330 bp, Homo sapiens; identical to SEQ ID NO: 445264
  misc_feature: HEFZJCU01C4AEX.53.44.D11.1.454.heavy.3.raw

SEQ ID NO: 448248 - DNA, 406 bp, Homo sapiens
  misc_feature: HEFZJCU01D160E.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctggggcacagcggccctgggctgcctggtcaaggactacttccgtatctctcg

SEQ ID NO: 448249 - DNA, 498 bp, Homo sapiens
  misc_feature: HEFZJCU01BSE5W.53.80.H03.1.454.heavy.3.raw
cgcgtatacacacgaccggtgctcgatttagctgtgcgtcgaagggaaagggggagcgtagtcacccagcaaccacatctgtcctctagagaatccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactgtccccggactttcg

SEQ ID NO: 448250 - DNA, 512 bp, Homo sapiens; identical to SEQ ID NO: 446702
  misc_feature: HEFZJCU01EX54E.14.25.C03.1.454.heavy.3.raw

SEQ ID NO: 448251 - DNA, 486 bp, Homo sapiens
  misc_feature: HEFZJCU01B8JX8.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggcctgggctgcctggtcaggactacttcctacgtcgtat

SEQ ID NO: 448252 - DNA, 398 bp, Homo sapiens; identical to SEQ ID NO: 444524
  misc_feature: HEFZJCU01ERKUP.7.60.F05.1.454.heavy.3.raw

SEQ ID NO: 448253 - DNA, 520 bp, Homo sapiens; identical to SEQ ID NO: 446666
  misc_feature: HEFZJCU01CVFLZ.7.78.H01.1.454.heavy.3.raw

SEQ ID NO: 448254 - DNA, 484 bp, Homo sapiens
  misc_feature: HEFZJCU01DH9EP.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttta

SEQ ID NO: 448255 - DNA, 495 bp, Homo sapiens
  misc_feature: HEFZJCU01B3FWV.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggcaaggacaatggtcacgtct

SEQ ID NO: 448256 - DNA, 500 bp, Homo sapiens; identical to SEQ ID NO: 445720
  misc_feature: HEFZJCU01B4I3O.3.20.B09.1.454.heavy.3.raw

SEQ ID NO: 448257 - DNA, 491 bp, Homo sapiens; identical to SEQ ID NO: 448077
  misc_feature: HEFZJCU01ETLY3.11.38.D05.1.454.heavy.3.raw

SEQ ID NO: 448258 - DNA, 501 bp, Homo sapiens; identical to SEQ ID NO: 447719
  misc_feature: HEFZJCU01CSZTG.17.10.A10.1.454.heavy.3.raw

SEQ ID NO: 448259 - DNA, 522 bp, Homo sapiens
  misc_feature: HEFZJCU01DCSOY.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggggggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggtatgtctggggccaaggtacagcggtcaccgtcgcctcagcctccaccaagggcccatcggtcttcccctggcaccctcctccaagagcacctctgggggcac

SEQ ID NO: 448260 - DNA, 482 bp, Homo sapiens
  misc_feature: HEFZJCU01CSJNF.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatgggagggccgattcaccatctccagagactttttctcagaacacactgtctcttcaaatgaacagcctgagggccgaggacacggccgtctattattgtgtgagagtttatggcgatggctggtggacagatcactggggccaggggaaccctggtcaccgtctcctcagcctccaccaagggcccatcggtcttcccctggcgccctgctccaggagcacctccgagagcacagcggcctgggctgcctggtcaaggactacttcccacgagagta

SEQ ID NO: 448261 - DNA, 528 bp, Homo sapiens
  misc_feature: HEFZJCU01AGI15.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccg

SEQ ID NO: 448262 - DNA, 500 bp, Homo sapiens
  misc_feature: HEFZJCU01CR1V6.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccggaggggacgtatgacc

SEQ ID NO: 448263 - DNA, 500 bp, Homo sapiens; identical to SEQ ID NO: 444529
  misc_feature: HEFZJCU01AM328.12.38.D05.1.454.heavy.3.raw

SEQ ID NO: 448264 - DNA, 489 bp, Homo sapiens
  misc_feature: HEFZJCU01D371A.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagctccaccaagggcccatcggtcttcccctggcgccctgctccaggagcacctccgagagcacagcggccctgggctgcctggtcaaggactactccgtatctctcg

SEQ ID NO: 448265 - DNA, 507 bp, Homo sapiens
  misc_feature: HEFZJCU01D43V9.48.79.H02.1.454.heavy.3.raw
agtatacatacacgaccggtgctcgatttagtgtcacacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 448266 - DNA, 521 bp, Homo sapiens
  misc_feature: HEFZJCU01DX5SM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggccaggggaccctggtcatcgtctccccagcctccaccaagggcccatcggtcttccccctggcg

SEQ ID NO: 448267 - DNA, 491 bp, Homo sapiens; identical to SEQ ID NO: 445333
  misc_feature: HEFZJCU01D4E5W.19.53.E09.1.454.heavy.3.raw

SEQ ID NO: 448268 - DNA, 546 bp, Homo sapiens
  misc_feature: HEFZJCU01CIYTT.53.68.G02.1.454.heavy.3.raw
  modified_base (462)..(462): a, c, t, g, unknown or other
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgtcaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttgactggtttcgtcccatggaatccctactttnagtactgggcgcggagccctggtcaccgtctcctcacgcctcccaccaacggggcccactcgggtcttccccctcggtcaccct

SEQ ID NO: 448269 - DNA, 507 bp, Homo sapiens
  misc_feature: HEFZJCU01A9XNA.22.86.H09.1.454.heavy.3.raw
  modified_base (504)..(504): a, c, t, g, unknown or other
acatacgcgtcacgaccggtgctcgatttagtgctatagacttgggtttgggctgagcgtggtttcgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggccgccctgctccncgg

SEQ ID NO: 448270 - DNA, 511 bp, Homo sapiens
  misc_feature: HEFZJCU01B1GAT.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttccccctggcgccctgctccaggagcacctctgggggcacagcggccctgggctgcctggtcaggactacttcccatac

SEQ ID NO: 448271 - DNA, 489 bp, Homo sapiens
  misc_feature: HEFZJCU01C5EJG.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaaggactacttccatactcgta

SEQ ID NO: 448272 - DNA, 516 bp, Homo sapiens
  misc_feature: HEFZJCU01CAACH.51.26.C04.1.454.heavy.3.raw
cgatcgtatacacgaccggtgctcgatttagtctagcgactttgggtttggggtctgggagacgagcccagcactggaagtcgccggtgtttccattcggtgatcatcactgaacacagacatggagtttgggctgagcgtgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacgggagttacttcctcgcaacggtatc

SEQ ID NO: 448273 - DNA, 484 bp, Homo sapiens
  misc_feature: HEFZJCU01AKTSL.19.67.G01.1.454.heavy.3.raw
tactctcgtgcacgaccggtgctcgatttagagtatacatattgggcttggtccagcctgggcggtcgtctggagaacgtgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 448274 - DNA, 436 bp, Homo sapiens; identical to SEQ ID NO: 444849
  misc_feature: HEFZJCU01DR5L5.53.40.D07.1.454.heavy.3.raw

SEQ ID NO: 448275 - DNA, 523 bp, Homo sapiens
  misc_feature: HEFZJCU01EHWP0.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccg

SEQ ID NO: 448276 - DNA, 313 bp, Homo sapiens; identical to SEQ ID NO: 444518
  misc_feature: HEFZJCU01DONGC.7.10.A10.1.454.heavy.3.raw

SEQ ID NO: 448277 - DNA, 431 bp, Homo sapiens
  misc_feature: HEFZJCU01CXRJL.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctccgaggagcacagcggccctgggctgcctggtcaaggactacttccagtcgctaga

SEQ ID NO: 448278 - DNA, 531 bp, Homo sapiens
  misc_feature: HEFZJCU01CHE7H.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaagggcagtggctgggacatggacgtctggggccaagggaccacggtcaccgt

SEQ ID NO: 448279 - DNA, 530 bp, Homo sapiens
  misc_feature: HEFZJCU01EKC7M.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 448280 - DNA, 511 bp, Homo sapiens
  misc_feature: HEFZJCU01DINK4.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccac

SEQ ID NO: 448281 - DNA, 514 bp, Homo sapiens
  misc_feature: HEFZJCU01C6PEM.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtctttccccctcggca

SEQ ID NO: 448282 - DNA, 517 bp, Homo sapiens
  misc_feature: HEFZJCU01D8YSN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggacc

SEQ ID NO: 448283 - DNA, 506 bp, Homo sapiens
  misc_feature: HEFZJCU01DJVHG.3.26.C04.1.454.heavy.3.raw
agacgcactccacgaccggtgctcgatttagtctagcgactttgggtttggggggtaaggaggaagactgacggtccagtccgtgggaggtcccgtgagactctcctggtgcagcctctaggattcagcttcagtgactatgcgtatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacg

SEQ ID NO: 448284 - DNA, 504 bp, Homo sapiens
  misc_feature: HEFZJCU01CQYLT.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgtattttgtgcgagcgaccggggctcctcaatggctttcattacg

SEQ ID NO: 448285 - DNA, 374 bp, Homo sapiens; identical to SEQ ID NO: 444640
  misc_feature: HEFZJCU01BVKQG.7.37.D04.1.454.heavy.3.raw

SEQ ID NO: 448286 - DNA, 476 bp, Homo sapiens; identical to SEQ ID NO: 445752
  misc_feature: HEFZJCU01BO7GH.3.39.D06.1.454.heavy.3.raw

SEQ ID NO: 448287 - DNA, 375 bp, Homo sapiens; identical to SEQ ID NO: 444442
  misc_feature: HEFZJCU01CHI6M.48.23.C01.1.454.heavy.3.raw

SEQ ID NO: 448288 - DNA, 500 bp, Homo sapiens; identical to SEQ ID NO: 445811
  misc_feature: HEFZJCU01EII9E.48.34.D01.1.454.heavy.3.raw

SEQ ID NO: 448289 - DNA, 505 bp, Homo sapiens; identical to SEQ ID NO: 444759
  misc_feature: HEFZJCU01B0VW0.10.38.D05.1.454.heavy.3.raw

SEQ ID NO: 448290 - DNA, 400 bp, Homo sapiens; identical to SEQ ID NO: 444452
  misc_feature: HEFZJCU01CM001.47.24.C02.1.454.heavy.3.raw

SEQ ID NO: 448291 - DNA, 510 bp, Homo sapiens
  misc_feature: HEFZJCU01A9XH4.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttcccctggcaccctcctccaagagcacctctgggggcacagcggccctgggctgccg

SEQ ID NO: 448292 - DNA, 415 bp, Homo sapiens
  misc_feature: HEFZJCU01ANWC1.51.79.H02.1.454.heavy.3.raw
cgatcgtatacacgaccggtgctcgatttagtgtcacacgaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgtaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 448293 - DNA, 459 bp, Homo sapiens
  misc_feature: HEFZJCU01BSDS7.49.78.H01.1.454.heavy.3.raw
agtcgagagacacgaccggtgctcgatttagtgtgagtagtttgggtttggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 448294 - DNA, 526 bp, Homo sapiens
  misc_feature: HEFZJCU01EMD1K.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagagggacggactacggtgactacgtgggggttcaccccgtggggccagggaaccctggtcaccgtctcctcagcctccaccg

SEQ ID NO: 448295 - DNA, 471 bp, Homo sapiens
  misc_feature: HEFZJCU01DS3JH.49.15.B04.1.454.heavy.3.raw
agtcgagagacacgaccggtgctcgatttagacagtatatatccgcgggcacgaccggtgctcgatttagacagtatatatccgcgggcacgaccggtgctcgatttagacacatacgcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 448296 - DNA, 315 bp, Homo sapiens; identical to SEQ ID NO: 444422
  misc_feature: HEFZJCU01ESP1W.47.84.H07.1.454.heavy.3.raw

SEQ ID NO: 448297 - DNA, 520 bp, Homo sapiens
  misc_feature: HEFZJCU01A6SAP.52.34.D01.1.454.heavy.3.raw
cgcagtacgacacgaccggtgctcgatttagatcgtctgtgttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaacgggcccatcggtcttccccctggccaccctcctccaagagcacctctgggggcacagcggccctgggctgcctggtcaaggactacttcctatacg

SEQ ID NO: 448298 - DNA, 489 bp, Homo sapiens
  misc_feature: HEFZJCU01CXJTX.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttccccctggcaccctcctccaagagcacctctgggggcacagcggccctgggctgcctggtcaaggactacttcctacgtcgtat

SEQ ID NO: 448299 - DNA, 506 bp, Homo sapiens
  misc_feature: HEFZJCU01ATS1O.52.37.D04.1.454.heavy.3.raw
cgcagtacgacacgaccggtgctcgatttagtagcatactgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 448300 - DNA, 500 bp, Homo sapiens; identical to SEQ ID NO: 444529
  misc_feature: HEFZJCU01BJC69.12.38.D05.1.454.heavy.3.raw

SEQ ID NO: 448301 - DNA, 403 bp, Homo sapiens; identical to SEQ ID NO: 444540
  misc_feature: HEFZJCU01C0J20.16.72.G06.1.454.heavy.3.raw

SEQ ID NO: 448302 - DNA, 518 bp, Homo sapiens; identical to SEQ ID NO: 445453
  misc_feature: HEFZJCU01C4FBE.9.34.D01.1.454.heavy.3.raw

SEQ ID NO: 448303 - DNA, 427 bp, Homo sapiens
  misc_feature: HEFZJCU01ATLTN.17.31.C09.1.454.heavy.3.raw
cgtagactagcacgaccggtgctcgatttagacgtctcatcaaggaaggaagggtgccagggggaagaccgatgggccctggtggatgggagggagttgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttccccctggcaccctcctccaagagcacctctgggggcacagcggccctgggctgcctggtcaaggactacttccctagtctacg

SEQ ID NO: 448304 - DNA, 514 bp, Homo sapiens
  misc_feature: HEFZJCU01A1I0O.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaaggtggaaccgacatatttcacaagctggcactggtacttcg

SEQ ID NO: 448305 - DNA, 523 bp, Homo sapiens
  misc_feature: HEFZJCU01CAKL9.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggtttccttgttaggctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatctttcaaatgaataacctgagagccgaggacacggccatgtattactgtgtggggcatttacttgacccctggggccgggaaccgacggtcgtaccgtccgtccc

SEQ ID NO: 448306 - DNA, 480 bp, Homo sapiens; identical to SEQ ID NO: 445011
  misc_feature: HEFZJCU01EHKCL.22.36.D03.1.454.heavy.3.raw

SEQ ID NO: 448307 - DNA, 396 bp, Homo sapiens; identical to SEQ ID NO: 444469
  misc_feature: HEFZJCU01EDPI7.47.46.E02.1.454.heavy.3.raw

SEQ ID NO: 448308 - DNA, 513 bp, Homo sapiens
  misc_feature: HEFZJCU01ERO67.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggaccg

SEQ ID NO: 448309 - DNA, 313 bp, Homo sapiens; identical to SEQ ID NO: 444447
  misc_feature: HEFZJCU01DMGKP.7.10.A10.1.454.heavy.3.raw

SEQ ID NO: 448310 - DNA, 496 bp, Homo sapiens; identical to SEQ ID NO: 444697
  misc_feature: HEFZJCU01BLFQM.16.37.D04.1.454.heavy.3.raw

SEQ ID NO: 448311 - DNA, 379 bp, Homo sapiens
  misc_feature: HEFZJCU01BBO5O.2.86.H09.1.454.heavy.3.raw
acgctcgacacacgaccggtgctcgatttagtgctatagacttggggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttccccctggcgccctgctccaggagcacctccgagagcacagcggccctgggctgcctggtcaggactacttcctgtcgagcgt

SEQ ID NO: 448312 - DNA, 523 bp, Homo sapiens
  misc_feature: HEFZJCU01C0D52.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggccccatccgtcttccccctggcgccctgctccacggagcacctccgagagcacagcggccctgggctgcctggtcaaggactacttcctacg

SEQ ID NO: 448313 - DNA, 506 bp, Homo sapiens
  misc_feature: HEFZJCU01C0Z1G.52.34.D01.1.454.heavy.3.raw
cgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 448314 - DNA, 487 bp, Homo sapiens
  misc_feature: HEFZJCU01BYW6D.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggttttcgcagctcgtccggcgggcccagttgaacatgactatcactactac

SEQ ID NO: 448315 - DNA, 503 bp, Homo sapiens; identical to SEQ ID NO: 445162
  misc_feature: HEFZJCU01CPHUZ.21.70.G04.1.454.heavy.3.raw

SEQ ID NO: 448316 - DNA, 486 bp, Homo sapiens
  misc_feature: HEFZJCU01CQS80.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattacta

SEQ ID NO: 448317 - DNA, 503 bp, Homo sapiens
  misc_feature: HEFZJCU01CHHVF.51.59.F04.1.454.heavy.3.raw
cgatcgtatacacgaccggtgctcgatttagtacacacacttagggattggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaatgaacagcctgagagctgaggacacggctattgttttactgttgcgagagggaactcgattacagcacg

SEQ ID NO: 448318 - DNA, 483 bp, Homo sapiens; identical to SEQ ID NO: 444639
  misc_feature: HEFZJCU01DI5ZK.11.23.C01.1.454.heavy.3.raw

SEQ ID NO: 448319 - DNA, 483 bp, Homo sapiens
  misc_feature: HEFZJCU01A62KJ.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactgggccagggatccctggtcgccgtcggctcagcctccaccaagggcccatcggtcttccccctggcgccctgctccaggagcacctccgagagcacagcggccctgggcctgcctggtcaaggactacttcctacgtgagct

SEQ ID NO: 448320 - DNA, 510 bp, Homo sapiens
  misc_feature: HEFZJCU01DVJKT.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgttcatctgaggcagtgttcaatggtatgcagactccgtgaagggccgattcaccatctccagagacaattccaggaacacaatgtatttggaaatgaacagcctaagtcctgaggacacggtgtatactactgtacgaaggagggggaaccagcggagttccaagtactc

SEQ ID NO: 448321 - DNA, 372 bp, Homo sapiens; identical to SEQ ID NO: 444513
  misc_feature: HEFZJCU01DO99R.5.23.C01.1.454.heavy.3.raw

SEQ ID NO: 448322 - DNA, 498 bp, Homo sapiens
  misc_feature: HEFZJCU01EWAYU.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccg

SEQ ID NO: 448323 - DNA, 394 bp, Homo sapiens; identical to SEQ ID NO: 444701
  misc_feature: HEFZJCU01CE5B1.3.12.B01.1.454.heavy.3.raw

SEQ ID NO: 448324 - DNA, 400 bp, Homo sapiens; identical to SEQ ID NO: 444452
  misc_feature: HEFZJCU01EMDAF.47.24.C02.1.454.heavy.3.raw

SEQ ID NO: 448325 - DNA, 518 bp, Homo sapiens; identical to SEQ ID NO: 444718
  misc_feature: HEFZJCU01CRD8Z.9.34.D01.1.454.heavy.3.raw

SEQ ID NO: 448326 - DNA, 509 bp, Homo sapiens
  misc_feature: HEFZJCU01BAGUG.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaaggcccatcggtcttcccctggcgccctgctccaggagcacctctgggggcgacagcggccctgggctgcctggtcaaggactacttcccata

SEQ ID NO: 448327 - DNA, 515 bp, Homo sapiens
  misc_feature: HEFZJCU01CFM27.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaac

SEQ ID NO: 448328 - DNA, 529 bp, Homo sapiens; identical to SEQ ID NO: 446480
  misc_feature: HEFZJCU01CQDOJ.18.33.C11.1.454.heavy.3.raw

SEQ ID NO: 448329 - DNA, 483 bp, Homo sapiens; identical to SEQ ID NO: 444639
  misc_feature: HEFZJCU01CHCGC.11.23.C01.1.454.heavy.3.raw

SEQ ID NO: 448330 - DNA, 529 bp, Homo sapiens
  misc_feature: HEFZJCU01DLAGP.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggataatttagcctacgcggactccgtcaagggccgattcaccgtctccagagacaacaccaagaacacactatatctgcagattgacagtctgagacccgaggacacggctgtgtattactgtgcaaggcagttcgtggaaactagttagtgggttggggggtaggttgggtttttttcgttacgtacggg

SEQ ID NO: 448331 - DNA, 408 bp, Homo sapiens; identical to SEQ ID NO: 446115
  misc_feature: HEFZJCU01BHDDV.51.71.G05.1.454.heavy.3.raw

SEQ ID NO: 448332 - DNA, 510 bp, Homo sapiens
  misc_feature: HEFZJCU01A0V9I.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaggactactt

SEQ ID NO: 448333 - DNA, 506 bp, Homo sapiens
  misc_feature: HEFZJCU01A65KG.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacacatgactaccg

SEQ ID NO: 448334 - DNA, 467 bp, Homo sapiens; identical to SEQ ID NO: 445004
  misc_feature: HEFZJCU01EF8GQ.16.78.H01.1.454.heavy.3.raw

SEQ ID NO: 448335 - DNA, 483 bp, Homo sapiens; identical to SEQ ID NO: 444639
  misc_feature: HEFZJCU01A62FZ.11.23.C01.1.454.heavy.3.raw

SEQ ID NO: 448336 - DNA, 538 bp, Homo sapiens
  misc_feature: HEFZJCU01EQ2FX.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggcacct

SEQ ID NO: 448337 - DNA, 379 bp, Homo sapiens
  misc_feature: HEFZJCU01CZXT8.47.41.D08.1.454.heavy.3.raw
agctcacgtacacgaccggtgctcgatttagtcacgcgagaaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 448338 - DNA, 381 bp, Homo sapiens; identical to SEQ ID NO: 445431
  misc_feature: HEFZJCU01EPKRR.3.70.G04.1.454.heavy.3.raw

SEQ ID NO: 448339 - DNA, 467 bp, Homo sapiens; identical to SEQ ID NO: 445159
  misc_feature: HEFZJCU01BM3TV.48.7.A07.1.454.heavy.3.raw

SEQ ID NO: 448340 - DNA, 523 bp, Homo sapiens
  misc_feature: HEFZJCU01AQ89X.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcc

SEQ ID NO: 448341 - DNA, 465 bp, Homo sapiens
  misc_feature: HEFZJCU01BIOE8.49.5.A05.1.454.heavy.3.raw
agtcgagagacacgaccggtgctcgatttagatagatagacaggggctgggagacgagcccagcactggaagtcgccggtgtttccattcggtgatcatcactgaacacagaggactcaccatggagtttgggctgagcgtggttttccgtcgttaggctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaaatactacgcagactccgtgaagggccgattcaccatctcccgacacaattccaagaacacattgtttctactgctgaacagcctgagaagtgacgacacggctgtatatca

SEQ ID NO: 448342 - DNA, 409 bp, Homo sapiens
  misc_feature: HEFZJCU01CJHTV.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcgcctctgggggcacagcggccctgggctgcctggtcaaggactacttccgagtgcgtct

SEQ ID NO: 448343 - DNA, 395 bp, Homo sapiens
  misc_feature: HEFZJCU01CWRW2.16.68.G02.1.454.heavy.3.raw
tgtactactccacgaccggtgctcgatttagtcgatagtgaagggaaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccggtagtaca

SEQ ID NO: 448344 - DNA, 509 bp, Homo sapiens
  misc_feature: HEFZJCU01CTOML.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattgggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccagcggagttccaagtactcctttg

SEQ ID NO: 448345 - DNA, 520 bp, Homo sapiens
  misc_feature: HEFZJCU01BX910.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttcccctggcgccctgctccaggcgcacctccgagagcacagcggccctgggctgcctggtcaaggactacttcctacg

SEQ ID NO: 448346 - DNA, 406 bp, Homo sapiens
  misc_feature: HEFZJCU01A53DD.53.77.G11.1.454.heavy.3.raw
cgcgtatacacacgaccggtgctcgatttagctagtcactcaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgaggggggggactagatttggtggctacgatcacccccatttttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 448347 - DNA, 376 bp, Homo sapiens; identical to SEQ ID NO: 448109
  misc_feature: HEFZJCU01D48I6.49.72.G06.1.454.heavy.3.raw

SEQ ID NO: 448348 - DNA, 480 bp, Homo sapiens; identical to SEQ ID NO: 445011
  misc_feature: HEFZJCU01EOR3V.22.36.D03.1.454.heavy.3.raw

SEQ ID NO: 448349 - DNA, 506 bp, Homo sapiens; identical to SEQ ID NO: 446636
  misc_feature: HEFZJCU01D5RHR.51.80.H03.1.454.heavy.3.raw

SEQ ID NO: 448350 - DNA, 508 bp, Homo sapiens
  misc_feature: HEFZJCU01D1U42.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccaccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgt

SEQ ID NO: 448351 - DNA, 522 bp, Homo sapiens
  misc_feature: HEFZJCU01BMCC8.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgttccgtggggccagggaaccctggtcaccgt

SEQ ID NO: 448352 - DNA, 339 bp, Homo sapiens
  misc_feature: HEFZJCU01AFHWY.18.53.E09.1.454.heavy.3.raw
tacgagtatgcacgaccggtgctcgatttagagagagtgtgttgggttgggtgcccaagctgctggagggcacggtcaccacgctgctgagcagcctgagatctgaggacacggccgtgtattactgtactagacaggtggattacatttgggggagttatcgcaaacgggggggtactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgta

SEQ ID NO: 448353 - DNA, 505 bp, Homo sapiens
  misc_feature: HEFZJCU01C49ZH.22.86.H09.1.454.heavy.3.raw
acatacgcgtcacgaccggtgctcgatttagtgctatagacttgggtttgggctgagcgtggttttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactaaatgtggactccgtgaagggccgattcaccatctccagagacaactccaagaacactctgtttctccaaatgaacagcctgagaggcgaggacacggcagtgtaattactgtgcgagagatcgacatgactacgggaaagcttttgatctctggggccaagggacactggtcaccgtctcttcagcctcaccaagggcccatccggtctcccctggcgcctgctcc

SEQ ID NO: 448354 - DNA, 371 bp, Homo sapiens; identical to SEQ ID NO: 444435
  misc_feature: HEFZJCU01BH4PV.3.42.D09.1.454.heavy.3.raw

SEQ ID NO: 448355 - DNA, 525 bp, Homo sapiens
  misc_feature: HEFZJCU01BI50L.49.34.D01.1.454.heavy.3.raw
agtcgagagacacgaccggtgctcgatttagatcgtctgtgttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcc

SEQ ID NO: 448356 - DNA, 511 bp, Homo sapiens; identical to SEQ ID NO: 448280
  misc_feature: HEFZJCU01BTJF4.16.71.G05.1.454.heavy.3.raw

SEQ ID NO: 448357 - DNA, 510 bp, Homo sapiens
  misc_feature: HEFZJCU01BVV6S.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgatttttggagtggttac

SEQ ID NO: 448358 - DNA, 482 bp, Homo sapiens; identical to SEQ ID NO: 444503
  misc_feature: HEFZJCU01DUDX6.7.10.A10.1.454.heavy.3.raw

SEQ ID NO: 448359 - DNA, 524 bp, Homo sapiens; identical to SEQ ID NO: 446153
  misc_feature: HEFZJCU01B53GK.12.86.H09.1.454.heavy.3.raw

SEQ ID NO: 448360 - DNA, 500 bp, Homo sapiens; identical to SEQ ID NO: 446033
  misc_feature: HEFZJCU01AYFF6.11.27.C05.1.454.heavy.3.raw

SEQ ID NO: 448361 - DNA, 477 bp, Homo sapiens; identical to SEQ ID NO: 444659
  misc_feature: HEFZJCU01BS2PF.16.10.A10.1.454.heavy.3.raw

SEQ ID NO: 448362 - DNA, 400 bp, Homo sapiens; identical to SEQ ID NO: 444452
  misc_feature: HEFZJCU01CV5SK.47.24.C02.1.454.heavy.3.raw

SEQ ID NO: 448363 - DNA, 487 bp, Homo sapiens
  misc_feature: HEFZJCU01BYVLT.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctcggcaccctcctccaagagcacctctgggggcacagcggcctgggctgcctggtcaggactacttcctacgtcgtat

SEQ ID NO: 448364 - DNA, 502 bp, Homo sapiens
  misc_feature: HEFZJCU01EBEOY.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgtt

SEQ ID NO: 448365 - DNA, 396 bp, Homo sapiens
  misc_feature: HEFZJCU01DKHI5.48.70.G04.1.454.heavy.3.raw
agtatacatacacgaccggtgctcgatttagtgtagtgtgaagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 448366 - DNA, 427 bp, Homo sapiens; identical to SEQ ID NO: 444708
  misc_feature: HEFZJCU01ALKMQ.9.34.D01.1.454.heavy.3.raw

SEQ ID NO: 448367 - DNA, 392 bp, Homo sapiens; identical to SEQ ID NO: 444626
  misc_feature: HEFZJCU01CB7SX.49.46.E02.1.454.heavy.3.raw

SEQ ID NO: 448368 - DNA, 497 bp, Homo sapiens; identical to SEQ ID NO: 445413
  misc_feature: HEFZJCU01CWGB3.16.37.D04.1.454.heavy.3.raw

SEQ ID NO: 448369 - DNA, 506 bp, Homo sapiens; identical to SEQ ID NO: 444696
  misc_feature: HEFZJCU01DENZ9.16.34.D01.1.454.heavy.3.raw

SEQ ID NO: 448370 - DNA, 396 bp, Homo sapiens; identical to SEQ ID NO: 444469
  misc_feature: HEFZJCU01C701Z.47.46.E02.1.454.heavy.3.raw

SEQ ID NO: 448371 - DNA, 507 bp, Homo sapiens
  misc_feature: HEFZJCU01BP7J5.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactactccgagtgcgtct

SEQ ID NO: 448372 - DNA, 464 bp, Homo sapiens; identical to SEQ ID NO: 445062
  misc_feature: HEFZJCU01AJLZ2.19.10.A10.1.454.heavy.3.raw

SEQ ID NO: 448373 - DNA, 511 bp, Homo sapiens
  misc_feature: HEFZJCU01BB5O6.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttcccctggca

SEQ ID NO: 448374 - DNA, 500 bp, Homo sapiens; identical to SEQ ID NO: 444529
  misc_feature: HEFZJCU01CAHXG.12.38.D05.1.454.heavy.3.raw

SEQ ID NO: 448375 - DNA, 501 bp, Homo sapiens
  misc_feature: HEFZJCU01BD0QH.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctgctccaggagcacctccgagagcacagcggccctgggctgcctggtcaaggactacttccgtactagacg

SEQ ID NO: 448376 - DNA, 386 bp, Homo sapiens
  misc_feature: HEFZJCU01BWIIL.14.57.F02.1.454.heavy.3.raw
cgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcaccctcctccaagagcacctctgggggcacagcggccctgggctgcctggtcaaggactacttccgtactagacg

SEQ ID NO: 448377 - DNA, 482 bp, Homo sapiens
  misc_feature: HEFZJCU01DXJFP.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagtggccctgggctgcctggtcaaggactacttcctagagacacg

SEQ ID NO: 448378 - DNA, 509 bp, Homo sapiens
  misc_feature: HEFZJCU01DPMZC.52.24.C02.1.454.heavy.3.raw
cgcagtacgacacgaccggtgctcgatttagtacagatcgttagggaaaggggctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaaggggctggagtgggtctcatttattagtactagttacttatactacgcagactcagtgaagggccgattcaccatctccagagacaacgccaggaattcactatatttgcaaatgaacagcctgcgagccgaggacacggctgtgtattactgtgcgcgagaacacagcaatggccatttcgatactgggaccg

SEQ ID NO: 448379 - DNA, 525 bp, Homo sapiens
  misc_feature: HEFZJCU01COMG6.52.53.E09.1.454.heavy.3.raw
cgcagtacgacacgaccggtgctcgatttagagagagtgtgttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttctcaaatggacagtctgagacctgacgacacggctgtctattactgtgcgagagaacccagggggcggagcagccccgtaattctggggccagggaacccggtcaccgtctcctcagcctccaccaagggcccatcggtcttcccctggcaccctcctccaagagcacctctc

SEQ ID NO: 448380 - DNA, 490 bp, Homo sapiens
  misc_feature: HEFZJCU01DKHJ7.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggccgccctgctccaggagcacctccgagagcacagcggccctggggctgcctggtcaaggactacttcctacgtgagct

SEQ ID NO: 448381 - DNA, 504 bp, Homo sapiens
  misc_feature: HEFZJCU01EUQAB.51.71.G05.1.454.heavy.3.raw
cgatcgtatacacgaccggtgctcgatttagtgtcgtcgcaagagagaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcc

SEQ ID NO: 448382 - DNA, 505 bp, Homo sapiens
  misc_feature: HEFZJCU01EHOFD.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggcttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgacttcg

SEQ ID NO: 448383 - DNA, 504 bp, Homo sapiens
  misc_feature: HEFZJCU01EZ013.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtctat

SEQ ID NO: 448384 - DNA, 518 bp, Homo sapiens; identical to SEQ ID NO: 446943
  misc_feature: HEFZJCU01A3YKS.7.78.H01.1.454.heavy.3.raw

SEQ ID NO: 448385 - DNA, 517 bp, Homo sapiens; identical to SEQ ID NO: 446608
  misc_feature: HEFZJCU01AKSEF.9.34.D01.1.454.heavy.3.raw

SEQ ID NO: 448386 - DNA, 482 bp, Homo sapiens; identical to SEQ ID NO: 444503
  misc_feature: HEFZJCU01BFHN4.7.10.A10.1.454.heavy.3.raw

SEQ ID NO: 448387 - DNA, 484 bp, Homo sapiens
  misc_feature: HEFZJCU01DIWO1.48.62.F07.1.454.heavy.3.raw
agtatacatacacgaccggtgctcgatttagtagtcgcataaagggaaaggggatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagagtggttattatctcc

SEQ ID NO: 448388 - DNA, 500 bp, Homo sapiens
  misc_feature: HEFZJCU01CR5K8.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggt

SEQ ID NO: 448389 - DNA, 513 bp, Homo sapiens; identical to SEQ ID NO: 446452
  misc_feature: HEFZJCU01B8M4T.17.33.C11.1.454.heavy.3.raw

SEQ ID NO: 448390 - DNA, 486 bp, Homo sapiens
  misc_feature: HEFZJCU01D7C9Q.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggcctgggctgcctggtcaaggactacttcccactactatg

SEQ ID NO: 448391 - DNA, 512 bp, Homo sapiens
  misc_feature: HEFZJCU01CG8ID.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgatttttggaactt

SEQ ID NO: 448392 - DNA, 488 bp, Homo sapiens
  misc_feature: HEFZJCU01D2ZK3.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactactccacgagagta

SEQ ID NO: 448393 - DNA, 396 bp, Homo sapiens; identical to SEQ ID NO: 444568
  misc_feature: HEFZJCU01BBHLA.47.46.E02.1.454.heavy.3.raw

SEQ ID NO: 448394 - DNA, 492 bp, Homo sapiens; identical to SEQ ID NO: 444827
  misc_feature: HEFZJCU01EQO1P.4.28.C06.1.454.heavy.3.raw

SEQ ID NO: 448395 - DNA, 518 bp, Homo sapiens; identical to SEQ ID NO: 444718
  misc_feature: HEFZJCU01BYYHZ.9.34.D01.1.454.heavy.3.raw

SEQ ID NO: 448396 - DNA, 492 bp, Homo sapiens
  misc_feature: HEFZJCU01BJLI3.53.87.H10.1.454.heavy.3.raw
cgcgtatacacacgaccggtgctcgatttagcagtactgcgttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatgtaccg

SEQ ID NO: 448397 - DNA, 522 bp, Homo sapiens
  misc_feature: HEFZJCU01B9CRE.12.40.D07.1.454.heavy.3.raw
atacgacgtacacgaccggtgctcgatttagtgatagagcgtaacaacagagggctcaccatggagtttgggctgagcgtggtttcgtcgtagctctttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggccctggtcatcgtctcccagcctccaccaagggcccatcggtcttcccctggccgcctcg

SEQ ID NO: 448398 - DNA, 395 bp, Homo sapiens
  misc_feature: HEFZJCU01EURF3.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggcctgggctgcctggtcaaggactacttcctacgtgagct

SEQ ID NO: 448399 - DNA, 528 bp, Homo sapiens
  misc_feature: HEFZJCU01DLJY4.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactatggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggcgccctcgctccaggagcacctccgacg

SEQ ID NO: 448400 - DNA, 523 bp, Homo sapiens
  misc_feature: HEFZJCU01EF8QO.53.9.A09.1.454.heavy.3.raw
  modified_base (394)..(394): a, c, t, g, unknown or other
cgcgtatacacacgaccggtgctcgatttagcgagacgcgcaggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggttgagtctgggggaggcttggtacagccagggcggtccctgagactctcctgtacaacttcaggattcacctttggtgattatgctatgacctgggtccgccaggctccagggaagggcctggagtgggtaggtttcgttagaagcaaaactgatggtggacaacagaatacgccgcgtctgtgaaaggcagatttancatctcaagagacgattccaaaggcatcgcctatctgcaaatgaacagcctgaaaaccgaggacacagccgtgtatttctgtactagagtcttcttgttattactatgatactagtggttttacaggta

SEQ ID NO: 448401 - DNA, 464 bp, Homo sapiens; identical to SEQ ID NO: 445062
  misc_feature: HEFZJCU01CX3D8.19.10.A10.1.454.heavy.3.raw

SEQ ID NO: 448402 - DNA, 491 bp, Homo sapiens; identical to SEQ ID NO: 445333
  misc_feature: HEFZJCU01AOI46.19.53.E09.1.454.heavy.3.raw

SEQ ID NO: 448403 - DNA, 414 bp, Homo sapiens
  misc_feature: HEFZJCU01AUN2K.51.41.D08.1.454.heavy.3.raw
cgatcgtatacacgaccggtgctcgatttagtcacgcgagaaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggcctgggctgcctggtcaaggactacttcctcgtagcact

SEQ ID NO: 448404 - DNA, 509 bp, Homo sapiens
  misc_feature: HEFZJCU01CUDXM.52.86.H09.1.454.heavy.3.raw
  modified_base (494)..(494): a, c, t, g, unknown or other
cgcagtacgacacgaccggtgctcgatttagtgctatagacttgggtttgggcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttcccagagacaacatcaagaactcaatgtatctccaaatgagcagcctgacatccgaggacacggccgtgtattactgtgcgagagttctttgggatgttgtcgttgcaccagctgccctaccggctgctacttcgatctctgggccgtggcaccctggtcactgtcttctcagcctccaccaagggcccatcggtcttcccctggtcaccctcctccaagagcacctctggggcacngcgccctgggctgcc

SEQ ID NO: 448405 - DNA, 530 bp, Homo sapiens
  misc_feature: HEFZJCU01EK8LH.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctgggccagggaaccctggtcaccgtctcctcagcctccaccaagggcccatcggtcttccccctggccccgcctcgctccaggagcacctccgagacg

SEQ ID NO: 448406 - DNA, 483 bp, Homo sapiens
  misc_feature: HEFZJCU01CFN07.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 448407 - DNA, 400 bp, Homo sapiens; identical to SEQ ID NO: 444452
  misc_feature: HEFZJCU01EJI5A.47.24.C02.1.454.heavy.3.raw

SEQ ID NO: 448408 - DNA, 501 bp, Homo sapiens
  misc_feature: HEFZJCU01DXDU4.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgacgagcacagcggccctgggctgcctggtcaaggactacttcctatgtatact

SEQ ID NO: 448409 - DNA, 486 bp, Homo sapiens
  misc_feature: HEFZJCU01CZZ9A.49.73.G07.1.454.heavy.3.raw
agtcgagagacacgaccggtgctcgatttagctctacgctcagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaaagacacggctgtctattactgtgcgactgagatgtctt

SEQ ID NO: 448410 - DNA, 491 bp, Homo sapiens; identical to SEQ ID NO: 446104
  misc_feature: HEFZJCU01DPEFF.3.34.D01.1.454.heavy.3.raw

SEQ ID NO: 448411 - DNA, 489 bp, Homo sapiens; identical to SEQ ID NO: 444591
  misc_feature: HEFZJCU01BJY96.18.70.G04.1.454.heavy.3.raw

SEQ ID NO: 448412 - DNA, 521 bp, Homo sapiens; identical to SEQ ID NO: 447111
  misc_feature: HEFZJCU01D3SYD.16.86.H09.1.454.heavy.3.raw

SEQ ID NO: 448413 - DNA, 516 bp, Homo sapiens
  misc_feature: HEFZJCU01CXUZI.52.33.C11.1.454.heavy.3.raw
cgcagtacgacacgaccggtgctcgatttagagtgagctcgttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctgtcaaggactacttcctatacg

SEQ ID NO: 448414 - DNA, 486 bp, Homo sapiens; identical to SEQ ID NO: 444861
  misc_feature: HEFZJCU01CUXXQ.47.55.E11.1.454.heavy.3.raw

SEQ ID NO: 448415 - DNA, 489 bp, Homo sapiens; identical to SEQ ID NO: 444591
  misc_feature: HEFZJCU01CWPHB.18.70.G04.1.454.heavy.3.raw

SEQ ID NO: 448416 - DNA, 503 bp, Homo sapiens
  misc_feature: HEFZJCU01DZH5J.16.71.G05.1.454.heavy.3.raw
tgtactactccacgaccggtgctcgatttagtgtcgtcgcaagagagagggggagctctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaccc

SEQ ID NO: 448417 - DNA, 521 bp, Homo sapiens
  misc_feature: HEFZJCU01D4XP7.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaaggg

SEQ ID NO: 448418 - DNA, 506 bp, Homo sapiens; identical to SEQ ID NO: 444696
  misc_feature: HEFZJCU01CU0T9.16.34.D01.1.454.heavy.3.raw

SEQ ID NO: 448419 - DNA, 536 bp, Homo sapiens
  misc_feature: HEFZJCU01B5ND4.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagcggtggtttcgtcgtaggcgtactttaaaaggtgtccagtgtgaggtgcagctggtggagtctgggggaggcttggtaaagccggggggtcccttagactccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctacaagagatgattcaaaaagcacgctgtgtctgcaaatgaacagcctgagaccgaggacacagccgtgtattactgtaccacatcccctgaaagcgtacaactctactactacgtatggacctctggggccaa

SEQ ID NO: 448420 - DNA, 502 bp, Homo sapiens
  misc_feature: HEFZJCU01D4N75.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctggctgcctggtcaaggactactccactacta

SEQ ID NO: 448421 - DNA, 551 bp, Homo sapiens
  misc_feature: HEFZJCU01CBJDI.16.1.A01.1.454.heavy.3.raw
tgtactactccacgaccggtgctcgatttagacgtctcatcagggtgtccttgggttttggggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaagggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggcttttgattttctggggccaagggacagtggtcaccgtctcttcagcctccaccaagggcccatcggtcttcccctggcaccctcctccaagagcacctctgggggcacagcggccctgggctgcctggtcaaggactacttccgagtagtaca

SEQ ID NO: 448422 - DNA, 511 bp, Homo sapiens
  misc_feature: HEFZJCU01EWUQ7.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctggagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 448423 - DNA, 519 bp, Homo sapiens
  misc_feature: HEFZJCU01EHDX4.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggtttgactactggggccagggaagcttggtcaccgtctcctcagcct

SEQ ID NO: 448424 - DNA, 470 bp, Homo sapiens; identical to SEQ ID NO: 444866
  misc_feature: HEFZJCU01AJDME.4.36.D03.1.454.heavy.3.raw

SEQ ID NO: 448425 - DNA, 540 bp, Homo sapiens
  misc_feature: HEFZJCU01CHT7U.22.34.D01.1.454.heavy.3.raw
acatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggcgccctgctccaggagcacctccgagagcacagcggccctgggctgcctggtcaaggactacttccacg

SEQ ID NO: 448426 - DNA, 515 bp, Homo sapiens
  misc_feature: HEFZJCU01CK3ML.53.70.G04.1.454.heavy.3.raw
cgcgtatacacacgaccggtgctcgatttagtgtagtgtgaagggaaagggtggagtctgggggagacttggtacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaaggactacttcctcg

SEQ ID NO: 448427 - DNA, 507 bp, Homo sapiens
  misc_feature: HEFZJCU01EEBDG.12.55.E11.1.454.heavy.3.raw
atacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagacgtacggtgaccttttctggtatttcgattc

SEQ ID NO: 448428 - DNA, 396 bp, Homo sapiens; identical to SEQ ID NO: 444469
  misc_feature: HEFZJCU01AV4AD.47.46.E02.1.454.heavy.3.raw

SEQ ID NO: 448429 - DNA, 507 bp, Homo sapiens
  misc_feature: HEFZJCU01ED1FZ.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgac

SEQ ID NO: 448430 - DNA, 437 bp, Homo sapiens; identical to SEQ ID NO: 447018
  misc_feature: HEFZJCU01DPEPB.40.27.C05.1.454.heavy.3.raw

SEQ ID NO: 448431 - DNA, 529 bp, Homo sapiens
  misc_feature: HEFZJCU01EU4JM.49.34.D01.1.454.heavy.3.raw
agtcgagagacacgaccggtgctcgatttagatcgtctgtgttgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttcccctggcaccctcctccaagagcacctctgggggcacagcggccctc

SEQ ID NO: 448432 - DNA, 383 bp, Homo sapiens; identical to SEQ ID NO: 446779
  misc_feature: HEFZJCU01A6RSI.47.60.F05.1.454.heavy.3.raw

SEQ ID NO: 448433 - DNA, 505 bp, Homo sapiens
  misc_feature: HEFZJCU01CABIE.51.24.C02.1.454.heavy.3.raw
cgatcgtatacacgaccggtgctcgatttagtacagatcgttagggaaagggggctctgggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatgaagggccgatccaccatctccagggacaattccaagaacacactgtatctgacaaataaacaacctgagagttgcggacacggctgtctattactgtgcggcacgtggggactacggtgacacgt

SEQ ID NO: 448434 - DNA, 396 bp, Homo sapiens
  misc_feature: HEFZJCU01CC23Y.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctcccgagagcacagcggccctgggctgcctggtcaaggactacttccgagtagtaca

SEQ ID NO: 448435 - DNA, 500 bp, Homo sapiens
  misc_feature: HEFZJCU01C5NHX.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaggtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtggggccac

SEQ ID NO: 448436 - DNA, 505 bp, Homo sapiens
  misc_feature: HEFZJCU01BVDBZ.17.10.A10.1.454.heavy.3.raw
cgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgtttctgtcatcgtacaatttgataggctctatggactggacttctggggccaggggaccacggtgatcgtctcatcagcctccaccaagggcccatcggtcttccccctggcaccctcctccaagagcacctcg

SEQ ID NO: 448437 - DNA, 401 bp, Homo sapiens
  misc_feature: HEFZJCU01EHDKO.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcg

SEQ ID NO: 448438 - DNA, 527 bp, Homo sapiens
  misc_feature: HEFZJCU01D8PGZ.52.71.G05.1.454.heavy.3.raw
cgcagtacgacacgaccggtgctcgatttagtgtcgtcgcaagagagaggggcagggggcagggtgtacacctgtggttctcggggctgccctttggctttggagatggttttctcgatgggggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatgggcccattgactactggggccagggaaccctggtcaccgtct

SEQ ID NO: 448439 - DNA, 311 bp, Homo sapiens
  misc_feature: HEFZJCU01BTLRV.7.10.A10.1.454.heavy.3.raw
cgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggcctgggctgcctggtcaaggactacttcctagagacacg

SEQ ID NO: 448440 - DNA, 490 bp, Homo sapiens
  misc_feature: HEFZJCU01BNV2W.18.70.G04.1.454.heavy.3.raw
tacgagtatgcacgaccggtgctcgatttagtgtagtgtgaagggaaagggggaagaggaagactgacggtcctgccacaggtggtgctgggcacggtgggacactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttcccatactcgta

SEQ ID NO: 448441 - DNA, 513 bp, Homo sapiens; identical to SEQ ID NO: 446699
  misc_feature: HEFZJCU01D9E3A.12.25.C03.1.454.heavy.3.raw

SEQ ID NO: 448442 - DNA, 520 bp, Homo sapiens
  misc_feature: HEFZJCU01B1VUB.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgacagcctaagtcctgagggcacgggtgtatactactgtacgaaggaggggggaaccaggcgggagttccaagtactcctttgacgtctggggccg

SEQ ID NO: 448443 - DNA, 385 bp, Homo sapiens; identical to SEQ ID NO: 444438
  misc_feature: HEFZJCU01AXAT7.18.60.F05.1.454.heavy.3.raw

SEQ ID NO: 448444 - DNA, 510 bp, Homo sapiens; identical to SEQ ID NO: 444607
  misc_feature: HEFZJCU01CNG71.48.34.D01.1.454.heavy.3.raw

SEQ ID NO: 448445 - DNA, 510 bp, Homo sapiens
  misc_feature: HEFZJCU01DAG6R.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 448446 - DNA, 507 bp, Homo sapiens
  misc_feature: HEFZJCU01AC915.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcgtcaccgtctcctcagcctccaccaagggcccatcggtcttccccctggccg

SEQ ID NO: 448447 - DNA, 392 bp, Homo sapiens; identical to SEQ ID NO: 444682
  misc_feature: HEFZJCU01E1A52.16.70.G04.1.454.heavy.3.raw

SEQ ID NO: 448448 - DNA, 519 bp, Homo sapiens
  misc_feature: HEFZJCU01CBVH5.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgatctgtggggccgtggca

SEQ ID NO: 448449 - DNA, 318 bp, Homo sapiens
  misc_feature: HEFZJCU01DVO6V.13.66.F11.1.454.heavy.3.raw
tcacgtactacacgaccggtgctcgatttagtcacgcgagaagggcagagttcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctggggcacagcggccctgggctgcctggtcaaggactacttccgtactagacg

SEQ ID NO: 448450 - DNA, 483 bp, Homo sapiens; identical to SEQ ID NO: 444639
  misc_feature: HEFZJCU01CM8DD.11.23.C01.1.454.heavy.3.raw

SEQ ID NO: 448451 - DNA, 493 bp, Homo sapiens
  misc_feature: HEFZJCU01BHHCX.4.21.B10.1.454.heavy.3.raw
agcactgtagcacgaccggtgctcgatttagtgtcgtcgcaagagagggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaggactacttccctacagtgct

SEQ ID NO: 448452 - DNA, 426 bp, Homo sapiens
  misc_feature: HEFZJCU01B5N9L.51.61.F06.1.454.heavy.3.raw
cgatcgtatacacgaccggtgctcgatttagctacgctctaagggaaagggaaggggaaagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 448453 - DNA, 521 bp, Homo sapiens
  misc_feature: HEFZJCU01A47AW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacactaacctactggccaatactatgggggcttgttctggggccaggggaccctggtcatcgtctccccagcctccaccaagggcccatcggtcttcccctggcg

SEQ ID NO: 448454 - DNA, 505 bp, Homo sapiens
  misc_feature: HEFZJCU01B4RA5.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacccgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 448455 - DNA, 392 bp, Homo sapiens; identical to SEQ ID NO: 444682
  misc_feature: HEFZJCU01E0O4H.16.70.G04.1.454.heavy.3.raw

SEQ ID NO: 448456 - DNA, 540 bp, Homo sapiens
  misc_feature: HEFZJCU01DIQST.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatccggtcttccccctcggccaccctcctccaagagcacctctgggggcacgagcggccctgggctg

SEQ ID NO: 448457 - DNA, 484 bp, Homo sapiens
  misc_feature: HEFZJCU01BRHW8.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctcggcaccctcctccaagagcacctctgggggcacagcggccctgggctgcctggtcaaggactacttccgtatctctcg

SEQ ID NO: 448458 - DNA, 505 bp, Homo sapiens
  misc_feature: HEFZJCU01A2G2M.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggcctgggctgcctggtcaaggactacttccgagtagtaca

SEQ ID NO: 448459 - DNA, 490 bp, Homo sapiens
  misc_feature: HEFZJCU01CK6Z5.53.87.H10.1.454.heavy.3.raw
cgcgtatacacacgaccggtgctcgatttagcagtactgcgttgggtttggggacccaacaaccacatccctcctcagaagcccccagagcacaacgcctcaccatggactggacctggaggatcctctttttggtggcagcagccacaggtgcccactcccaggtccagcttgtgcagtctggggctgaggcgaagaagcctggggcctcagtgaaggtttcctgccaggcttctggatacaccctcagtacccatgctatccattgggtgcgccaggcccccggacaaagacttgagtggatgggatggatcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccc

SEQ ID NO: 448460 - DNA, 517 bp, Homo sapiens
  misc_feature: HEFZJCU01D9W3X.12.71.G05.1.454.heavy.3.raw
  modified_base (481)..(481): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggacccaggtcaccgtctcctcagcctccaccaagggcccatccgtcttcccctgccgcctgctccagagcacctcccgagagcacngcggccctgggctgcctggtcaggacacttcctacg

SEQ ID NO: 448461 - DNA, 506 bp, Homo sapiens; identical to SEQ ID NO: 445243
  misc_feature: HEFZJCU01CB7OT.48.27.C05.1.454.heavy.3.raw

SEQ ID NO: 448462 - DNA, 374 bp, Homo sapiens; identical to SEQ ID NO: 444640
  misc_feature: HEFZJCU01CTYSU.7.37.D04.1.454.heavy.3.raw

SEQ ID NO: 448463 - DNA, 483 bp, Homo sapiens; identical to SEQ ID NO: 444639
  misc_feature: HEFZJCU01EFS92.11.23.C01.1.454.heavy.3.raw

SEQ ID NO: 448464 - DNA, 470 bp, Homo sapiens; identical to SEQ ID NO: 444866
  misc_feature: HEFZJCU01BV9N0.4.36.D03.1.454.heavy.3.raw

SEQ ID NO: 448465 - DNA, 520 bp, Homo sapiens
  misc_feature: HEFZJCU01ELR72.13.71.G05.1.454.heavy.3.raw
tcacgtactacacgaccggtgctcgatttagtgtcgtcgcaagagagaggagccttagccctggactccaaggcctttccacttgtgatcagcactgagcacagaggactcaccatggaattggggctgagctgggttttccttgttgctattttagaaggtgtccagtgtgaggtgcagctggtggagtctggggggggcttggtccagcctggggggtccctgagactcgtcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacgggctgtgtattattgtgcgagagagtgggggcacggactattttgtagtaggtgtacgtgggggcccaggggacg

SEQ ID NO: 448466 - DNA, 512 bp, Homo sapiens
  misc_feature: HEFZJCU01A97X5.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacg

SEQ ID NO: 448467 - DNA, 491 bp, Homo sapiens
  misc_feature: HEFZJCU01D7N56.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattacta

SEQ ID NO: 448468 - DNA, 516 bp, Homo sapiens
  misc_feature: HEFZJCU01BKOR6.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctggggccagggaacccttgtcaccgtctcctcagcctccaccaagggccc

SEQ ID NO: 448469 - DNA, 371 bp, Homo sapiens; identical to SEQ ID NO: 444435
  misc_feature: HEFZJCU01EGGN1.3.42.D09.1.454.heavy.3.raw

SEQ ID NO: 448470 - DNA, 531 bp, Homo sapiens; identical to SEQ ID NO: 446857
  misc_feature: HEFZJCU01EY5N9.7.78.H01.1.454.heavy.3.raw

SEQ ID NO: 448471 - DNA, 513 bp, Homo sapiens; identical to SEQ ID NO: 446452
  misc_feature: HEFZJCU01EZWSM.17.33.C11.1.454.heavy.3.raw

SEQ ID NO: 448472 - DNA, 514 bp, Homo sapiens
  misc_feature: HEFZJCU01ENCMK.48.34.D01.1.454.heavy.3.raw
  modified_base (397)..(397): a, c, t, g, unknown or other
agtatacatacacgaccggtgctcgatttagatcgtctgtgttgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaaggggggancgagctcgtccatccacttcgactcctggggccagggaaccctggtcaccgtctcctcagcctccaccaagggcccatcggtcttcccctggccaccctcctccaagagcacctctc

SEQ ID NO: 448473 - DNA, 492 bp, Homo sapiens
  misc_feature: HEFZJCU01EFC99.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactctttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtta

SEQ ID NO: 448474 - DNA, 526 bp, Homo sapiens
  misc_feature: HEFZJCU01CAZ31.16.86.H09.1.454.heavy.3.raw
  modified_base (501)..(501): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccaggggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccactaggtttgactactgggggccaggggaancttggtccaccgtctcctcagccct

SEQ ID NO: 448475 - DNA, 511 bp, Homo sapiens
  misc_feature: HEFZJCU01AJO5E.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 448476 - DNA, 511 bp, Homo sapiens; identical to SEQ ID NO: 445268
  misc_feature: HEFZJCU01CS233.48.34.D01.1.454.heavy.3.raw

SEQ ID NO: 448477 - DNA, 496 bp, Homo sapiens
  misc_feature: HEFZJCU01DHKQS.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctggctgcctggtcaaggactaccg

SEQ ID NO: 448478 - DNA, 520 bp, Homo sapiens; identical to SEQ ID NO: 447178
  misc_feature: HEFZJCU01CDNNL.47.64.F09.1.454.heavy.3.raw

SEQ ID NO: 448479 - DNA, 313 bp, Homo sapiens; identical to SEQ ID NO: 444518
  misc_feature: HEFZJCU01AFLZC.7.10.A10.1.454.heavy.3.raw

SEQ ID NO: 448480 - DNA, 508 bp, Homo sapiens
  misc_feature: HEFZJCU01CY4YC.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccggagccctggt

SEQ ID NO: 448481 - DNA, 496 bp, Homo sapiens
  misc_feature: HEFZJCU01ES9O2.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgacgagcacagcggccctgggctgcctggtcaaggactacttccctacagtgct

SEQ ID NO: 448482 - DNA, 487 bp, Homo sapiens
  misc_feature: HEFZJCU01BP6QT.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgcattattgtgcgagagtggagtggcagtggatatcgacaatta

SEQ ID NO: 448483 - DNA, 499 bp, Homo sapiens
  misc_feature: HEFZJCU01A1H3R.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactgggggccggggaatcctggtcaccgtctcctcagcctccaccaagggcccatcggtcttcccctggcgccctgctccaggagcacctccgagagcacagccggccctgggctgcctggtcaaggactacttccagtcgctaga

SEQ ID NO: 448484 - DNA, 532 bp, Homo sapiens
  misc_feature: HEFZJCU01E1U8L.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggacccgtggtcatcgtcttccccacgcctccaccaacgggcccatcggtcttccccctggccgccctcg

SEQ ID NO: 448485 - DNA, 504 bp, Homo sapiens
  misc_feature: HEFZJCU01BO5UZ.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctctcagcctccaccaaggcccatcggtcttcccctggcaccctcctccaagagcacctctgggggcacagcggccctgggctgcctggtcaaggactacttccgagtagtaca

SEQ ID NO: 448486 - DNA, 409 bp, Homo sapiens; identical to SEQ ID NO: 444519
  misc_feature: HEFZJCU01EYGQL.3.41.D08.1.454.heavy.3.raw

SEQ ID NO: 448487 - DNA, 506 bp, Homo sapiens
  misc_feature: HEFZJCU01BSAHA.2.53.E09.1.454.heavy.3.raw
acgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaaggggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacgagggggggagcgacgccttttgactactggggccagggaacctggtcaccgtctcctcagcctccaccaaggg

SEQ ID NO: 448488 - DNA, 511 bp, Homo sapiens
  misc_feature: HEFZJCU01BGGUD.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggttcgacccctggggccagggaaccctgggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 448489 - DNA, 499 bp, Homo sapiens
  misc_feature: HEFZJCU01B6OXZ.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccgacagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggac

SEQ ID NO: 448490 - DNA, 485 bp, Homo sapiens
  misc_feature: HEFZJCU01ASJ0L.48.27.C05.1.454.heavy.3.raw
agtatacatacacgaccggtgctcgatttagacgcgatcgaagggtttggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatat

SEQ ID NO: 448491 - DNA, 513 bp, Homo sapiens; identical to SEQ ID NO: 446699
  misc_feature: HEFZJCU01CTRZZ.12.25.C03.1.454.heavy.3.raw

SEQ ID NO: 448492 - DNA, 499 bp, Homo sapiens
  misc_feature: HEFZJCU01DNYVI.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaatgaacagcctgagagccgaggacacggctgtgtattactgtgcgagaggagctattatctggaaccccgat

SEQ ID NO: 448493 - DNA, 490 bp, Homo sapiens
  misc_feature: HEFZJCU01ALSH0.10.34.D01.1.454.heavy.3.raw
catagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgttctgatggcgtatgctctaaggaggaccttgacttctggggccagggaaccctggtcaccgtctcctcagcctccaccaagggccatcggtcttcccctggcgccctgctccaggagcacctccgagagcacagcggccctgggctgcctggtcaaggactacttcccactactatg

SEQ ID NO: 448494 - DNA, 489 bp, Homo sapiens
  misc_feature: HEFZJCU01CXNEV.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggtcggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 448495 - DNA, 516 bp, Homo sapiens
  misc_feature: HEFZJCU01AWLCH.52.83.H06.1.454.heavy.3.raw
cgcagtacgacacgaccggtgctcgatttagatcacgtgcgtcgcggggctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggttgtttattactgtgcgtaacttaattacggaggactaaccggtaacccccgtccgaccg

SEQ ID NO: 448496 - DNA, 486 bp, Homo sapiens; identical to SEQ ID NO: 444861
  misc_feature: HEFZJCU01AFTZT.47.55.E11.1.454.heavy.3.raw

SEQ ID NO: 448497 - DNA, 488 bp, Homo sapiens
  misc_feature: HEFZJCU01C1USI.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggcctgggctgcctggtcaaggactacttcctacgtgagct

SEQ ID NO: 448498 - DNA, 532 bp, Homo sapiens
  misc_feature: HEFZJCU01A5M71.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactactggggcccggg

SEQ ID NO: 448499 - DNA, 528 bp, Homo sapiens
  misc_feature: HEFZJCU01BWOL5.49.25.C03.1.454.heavy.3.raw
agtcgagagacacgaccggtgctcgatttagtagtgtagatttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggatctcagaggtgaggacaccgccttctactactgtgcaaaagattacggtgaccacacctattttgaccactgcggccagggaaccctagtcaccgtctcctcagcctccaccaagggcccatcggtcttcccctggcaccctcctccaagagcacctctgggggcacagcggccctgggctgcctggtcaaggactacttcct

SEQ ID NO: 448500 - DNA, 492 bp, Homo sapiens
  misc_feature: HEFZJCU01BUOET.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcattactacgatagttatggta

SEQ ID NO: 448501 - DNA, 515 bp, Homo sapiens
  misc_feature: HEFZJCU01CMOYX.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcaatggctttcattactggggccac

SEQ ID NO: 448502 - DNA, 491 bp, Homo sapiens; identical to SEQ ID NO: 446104
  misc_feature: HEFZJCU01DKUU2.3.34.D01.1.454.heavy.3.raw

SEQ ID NO: 448503 - DNA, 337 bp, Homo sapiens; identical to SEQ ID NO: 446973
  misc_feature: HEFZJCU01D1CFT.52.58.F03.1.454.heavy.3.raw

SEQ ID NO: 448504 - DNA, 509 bp, Homo sapiens; identical to SEQ ID NO: 444586
  misc_feature: HEFZJCU01EEI3M.12.78.H01.1.454.heavy.3.raw

SEQ ID NO: 448505 - DNA, 511 bp, Homo sapiens
  misc_feature: HEFZJCU01B847I.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccagagcacctctgggggcacagcggccctgggctgcctggtcaaggactacttcccatac

SEQ ID NO: 448506 - DNA, 392 bp, Homo sapiens; identical to SEQ ID NO: 444682
  misc_feature: HEFZJCU01BQBXA.16.70.G04.1.454.heavy.3.raw

SEQ ID NO: 448507 - DNA, 508 bp, Homo sapiens
  misc_feature: HEFZJCU01CI8KK.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactactggggccagggaaccctggtcatcgtctcctcagcctccaccaagggcccatcggtcttcccctggccaccctcctccaagagcacctctgggggcacagcggccctgggctgcctggtcaaggactacttccgagtagtaca

SEQ ID NO: 448508 - DNA, 494 bp, Homo sapiens
  misc_feature: HEFZJCU01CR0B9.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattacttgtggggagagatggaggtcgatattgt

SEQ ID NO: 448509 - DNA, 495 bp, Homo sapiens
  misc_feature: HEFZJCU01B8CFT.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctcggcgccctcgctccacggagcacctccgacgagcacagcggcccgtcgggctgcctggtcaaggactacttcctacgtgagct

SEQ ID NO: 448510 - DNA, 492 bp, Homo sapiens; identical to SEQ ID NO: 444827
  misc_feature: HEFZJCU01AY8Y5.4.28.C06.1.454.heavy.3.raw

SEQ ID NO: 448511 - DNA, 512 bp, Homo sapiens
  misc_feature: HEFZJCU01BYD0H.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaatttggtcaccgtctccccagcctccaccaagggcccatcggtcttcccctggcgccctgctccaggagcacctccgagagcacagcggccctgggctgcctggtcaaggactact

SEQ ID NO: 448512 - DNA, 491 bp, Homo sapiens; identical to SEQ ID NO: 444592
  misc_feature: HEFZJCU01CXKCC.11.26.C04.1.454.heavy.3.raw

SEQ ID NO: 448513 - DNA, 520 bp, Homo sapiens
  misc_feature: HEFZJCU01CFW1Q.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtattttgtgcgagcgacccggggctcctcaatggctttcattactggggccagggaacccta

SEQ ID NO: 448514 - DNA, 314 bp, Homo sapiens; identical to SEQ ID NO: 444774
  misc_feature: HEFZJCU01B4S4X.7.10.A10.1.454.heavy.3.raw

SEQ ID NO: 448515 - DNA, 517 bp, Homo sapiens
  misc_feature: HEFZJCU01BVDZI.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctgggctgcctggtcaaggactacttcctagagacacg

SEQ ID NO: 448516 - DNA, 510 bp, Homo sapiens
  misc_feature: HEFZJCU01EJE3G.17.33.C11.1.454.heavy.3.raw
  modified_base (492)..(492): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattagtccctactttgactactgggccagggaactctggtcacgtctccgnagcctccaccaagggccc

SEQ ID NO: 448517 - DNA, 501 bp, Homo sapiens; identical to SEQ ID NO: 447719
  misc_feature: HEFZJCU01D462I.17.10.A10.1.454.heavy.3.raw

SEQ ID NO: 448518 - DNA, 506 bp, Homo sapiens; identical to SEQ ID NO: 444696
  misc_feature: HEFZJCU01BTE6B.16.34.D01.1.454.heavy.3.raw

SEQ ID NO: 448519 - DNA, 521 bp, Homo sapiens
  misc_feature: HEFZJCU01B478R.16.86.H09.1.454.heavy.3.raw
  modified_base (498)..(498): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccaggggaancttggtcaccgtctcctcagcct

SEQ ID NO: 448520 - DNA, 519 bp, Homo sapiens; identical to SEQ ID NO: 444867
  misc_feature: HEFZJCU01A6X3T.9.34.D01.1.454.heavy.3.raw

SEQ ID NO: 448521 - DNA, 387 bp, Homo sapiens; identical to SEQ ID NO: 445170
  misc_feature: HEFZJCU01BXDX2.27.46.E02.1.454.heavy.3.raw

SEQ ID NO: 448522 - DNA, 504 bp, Homo sapiens
  misc_feature: HEFZJCU01ER34G.17.31.C09.1.454.heavy.3.raw
  modified_base (459)..(459): a, c, t, g, unknown or other
cgtagactagcacgaccggtgctcgatttagacgtctcatcaaggaaggaagggctgtagttgatgtgagagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaaggccatcggtcttcccctggcaccctcctccaagagcacctctgggggcacngcggccctgggctgcctggtcaaggactacttccctagtcctacg

SEQ ID NO: 448523 - DNA, 312 bp, Homo sapiens; identical to SEQ ID NO: 444415
  misc_feature: HEFZJCU01BEI08.7.10.A10.1.454.heavy.3.raw

SEQ ID NO: 448524 - DNA, 390 bp, Homo sapiens
  misc_feature: HEFZJCU01DRHMG.22.46.E02.1.454.heavy.3.raw
acatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 448525 - DNA, 545 bp, Homo sapiens
  misc_feature: HEFZJCU01CNF6O.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctgggccaagggaccacggtcaccgtctcctcagcctccaccaagggcccatcggtcttccccctggcgccctgctccaggagcacctccgagagcacagcggccctgggccg

SEQ ID NO: 448526 - DNA, 483 bp, Homo sapiens; identical to SEQ ID NO: 444924
  misc_feature: HEFZJCU01DKA69.10.35.D02.1.454.heavy.3.raw

SEQ ID NO: 448527 - DNA, 467 bp, Homo sapiens; identical to SEQ ID NO: 445004
  misc_feature: HEFZJCU01BJUQU.16.78.H01.1.454.heavy.3.raw

SEQ ID NO: 448528 - DNA, 532 bp, Homo sapiens
  misc_feature: HEFZJCU01DCW33.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttggggtttttttttcgtacgttacgggt

SEQ ID NO: 448529 - DNA, 491 bp, Homo sapiens
  misc_feature: HEFZJCU01E179R.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctggggctgcctggtcaaggactactccgagtgcgtct

SEQ ID NO: 448530 - DNA, 314 bp, Homo sapiens; identical to SEQ ID NO: 444774
  misc_feature: HEFZJCU01BDXVX.7.10.A10.1.454.heavy.3.raw

SEQ ID NO: 448531 - DNA, 400 bp, Homo sapiens; identical to SEQ ID NO: 444452
  misc_feature: HEFZJCU01BWVU4.47.24.C02.1.454.heavy.3.raw

SEQ ID NO: 448532 - DNA, 535 bp, Homo sapiens; identical to SEQ ID NO: 446873
  misc_feature: HEFZJCU01DGRQK.17.28.C06.1.454.heavy.3.raw
  modified_base (523)..(523): a, c, t, g, unknown or other

SEQ ID NO: 448533 - DNA, 483 bp, Homo sapiens; identical to SEQ ID NO: 444924
  misc_feature: HEFZJCU01DTFHA.10.35.D02.1.454.heavy.3.raw

SEQ ID NO: 448534 - DNA, 531 bp, Homo sapiens
  misc_feature: HEFZJCU01CFZ4O.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaaggcccatcggtcttcccctggcaccctcctccaagacgcacctctgggggcacagcggcctgggctgcctc

SEQ ID NO: 448535 - DNA, 370 bp, Homo sapiens; identical to SEQ ID NO: 446460
  misc_feature: HEFZJCU01C1K7C.14.77.G11.1.454.heavy.3.raw

SEQ ID NO: 448536 - DNA, 401 bp, Homo sapiens; identical to SEQ ID NO: 448437
  misc_feature: HEFZJCU01B6IKP.11.70.G04.1.454.heavy.3.raw

SEQ ID NO: 448537 - DNA, 370 bp, Homo sapiens
  misc_feature: HEFZJCU01CB8VT.3.42.D09.1.454.heavy.3.raw
agacgcactccacgaccggtgctcgatttagacacatacgcagggaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctggctgcctggtcaaggactacttccgagtgcgtct

SEQ ID NO: 448538 - DNA, 497 bp, Homo sapiens
  misc_feature: HEFZJCU01EBHH0.51.37.D04.1.454.heavy.3.raw
cgatcgtatacacgaccggtgctcgatttagtagcatactgttgggtttggggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggctactt

SEQ ID NO: 448539 - DNA, 400 bp, Homo sapiens; identical to SEQ ID NO: 444452
  misc_feature: HEFZJCU01CR5PI.47.24.C02.1.454.heavy.3.raw

SEQ ID NO: 448540 - DNA, 462 bp, Homo sapiens
  misc_feature: HEFZJCU01AJ8JT.5.86.H09.1.454.heavy.3.raw
atcagacacgcacgaccggtgctcgatttagtgctatagacttgggtttgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatcggtcttcccctggcgccctgctccaggagcacctccgagagcacagcggcctgggctgcctggtcaaggactacttccgtgtctgat

SEQ ID NO: 448541 - DNA, 510 bp, Homo sapiens
  misc_feature: HEFZJCU01CIW98.51.54.E10.1.454.heavy.3.raw
cgatcgtatacacgaccggtgctcgatttagatcgtagcagaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggtttcgagggctcc

SEQ ID NO: 448542 - DNA, 336 bp, Homo sapiens; identical to SEQ ID NO: 444510
  misc_feature: HEFZJCU01DNWX0.3.31.C09.1.454.heavy.3.raw

SEQ ID NO: 448543 - DNA, 519 bp, Homo sapiens; identical to SEQ ID NO: 445330
  misc_feature: HEFZJCU01C0Y2J.7.78.H01.1.454.heavy.3.raw

SEQ ID NO: 448544 - DNA, 489 bp, Homo sapiens
  misc_feature: HEFZJCU01DC5P7.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccagagcacctctggggcacagcggccctgggctgcctggtcaaggactacttcctattgtatact

SEQ ID NO: 448545 - DNA, 427 bp, Homo sapiens; identical to SEQ ID NO: 444708
  misc_feature: HEFZJCU01B7RCV.9.34.D01.1.454.heavy.3.raw

SEQ ID NO: 448546 - DNA, 504 bp, Homo sapiens; identical to SEQ ID NO: 445399
  misc_feature: HEFZJCU01AS3SH.17.74.G08.1.454.heavy.3.raw

SEQ ID NO: 448547 - DNA, 518 bp, Homo sapiens
  misc_feature: HEFZJCU01DS83U.40.37.D04.1.454.heavy.3.raw
  modified_base (470)..(470): a, c, t, g, unknown or other
tctagcgactcacgaccggtgctcgatttagtagcatactgttgggtttggggagctctgagagaggagcccagccctgggattttcaggtgttttcatttggtgatcaggactgaacagagagaactcaccatggagtttgggctgagcgtggcttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccaggggacggggctggagtgggtttcatctattggtggtggtggcattgacacacactacgccgactccgtgaagggccggttcaccatctccagagacaattccaggaacacactgtatctgcaaatgaacggctgacagccgaggacacggccaaatnttactgtgtgaaggatcaggaagtgggagcgtggtaggcctcgaatac

SEQ ID NO: 448548 - DNA, 539 bp, Homo sapiens
  misc_feature: HEFZJCU01D10I7.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgcgcggacacggctgtctattactgtgcgagaggccccttagtttcggttttggactggttctcccatggaatccctactttgagttactgggggccgcgggagccctggtccaccgtctcctcagcctccaccaagggcccatcggtctcccctggccacct

SEQ ID NO: 448549 - DNA, 492 bp, Homo sapiens
  misc_feature: HEFZJCU01D3F3J.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctcgctccaggagcacctccgagagcacagcggccctgggctgcctggtcaggactacttccctacagtgct

SEQ ID NO: 448550 - DNA, 491 bp, Homo sapiens
  misc_feature: HEFZJCU01EH9BG.53.62.F07.1.454.heavy.3.raw
cgcgtatacacacgaccggtgctcgatttagtagtcgcataaagggaaagggggggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcaggtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttact

SEQ ID NO: 448551 - DNA, 525 bp, Homo sapiens; identical to SEQ ID NO: 448120
  misc_feature: HEFZJCU01CYSM7.22.85.H08.1.454.heavy.3.raw

SEQ ID NO: 448552 - DNA, 443 bp, Homo sapiens
  misc_feature: HEFZJCU01DCT8R.10.11.A11.1.454.heavy.3.raw
catagtagtgcacgaccggtgctcgatttagctacgactgcagggtgtacacctgtggttctcggggccgccggaaagggcccggagtggcttggtcggatctctctcactgggaacaccctatacaacccctctttcatgggtcgactctccctttcactggacctgtctgagaaccagttctccatgacactgacctctgtcatcgccgctgacacggccgtctatttctgcgcgtcctcatcccttattcatcatgatggttctacttattattacgagagatctgagtttgaccactggggccagggcatgctagtcaccgtctccccagcctccaccaagggcccatcggtcttccccctggcaccctcctccaagagcacctctgggggcacagcggccctgggctgcctggtcaaggactacttcacactactatg

SEQ ID NO: 448553 - DNA, 421 bp, Homo sapiens
  misc_feature: HEFZJCU01BXAS6.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctggggcacagcggccctgggctgcctggtcaaggactacttccgagtagtaca

SEQ ID NO: 448554 - DNA, 501 bp, Homo sapiens
  misc_feature: HEFZJCU01DWUTL.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagccggccctgggctgcctggtcaaggactacttcctacgtcgtat

SEQ ID NO: 448555 - DNA, 531 bp, Homo sapiens; identical to SEQ ID NO: 446857
  misc_feature: HEFZJCU01DM3C4.7.78.H01.1.454.heavy.3.raw

SEQ ID NO: 448556 - DNA, 332 bp, Homo sapiens; identical to SEQ ID NO: 446898
  misc_feature: HEFZJCU01BU35G.12.71.G05.1.454.heavy.3.raw

SEQ ID NO: 448557 - DNA, 370 bp, Homo sapiens; identical to SEQ ID NO: 446460
  misc_feature: HEFZJCU01CDTYK.14.77.G11.1.454.heavy.3.raw

SEQ ID NO: 448558 - DNA, 482 bp, Homo sapiens; identical to SEQ ID NO: 444503
  misc_feature: HEFZJCU01CK0DC.7.10.A10.1.454.heavy.3.raw

SEQ ID NO: 448559 - DNA, 379 bp, Homo sapiens; identical to SEQ ID NO: 444450
  misc_feature: HEFZJCU01BKX77.47.77.G11.1.454.heavy.3.raw

SEQ ID NO: 448560 - DNA, 506 bp, Homo sapiens
  misc_feature: HEFZJCU01C4KWV.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgactttcgtc

SEQ ID NO: 448561 - DNA, 513 bp, Homo sapiens
  misc_feature: HEFZJCU01DJ6YY.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtgcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaccaggcggagttcaagtactcc

SEQ ID NO: 448562 - DNA, 372 bp, Homo sapiens; identical to SEQ ID NO: 444727
  misc_feature: HEFZJCU01BKRLN.3.42.D09.1.454.heavy.3.raw

SEQ ID NO: 448563 - DNA, 414 bp, Homo sapiens
  misc_feature: HEFZJCU01BONK5.14.74.G08.1.454.heavy.3.raw
cgtctagtaccacgaccggtgctcgatttagtagctctatcagggaagggactggagtggattggtaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggatacttccgtactagacg

SEQ ID NO: 448564 - DNA, 491 bp, Homo sapiens; identical to SEQ ID NO: 445333
  misc_feature: HEFZJCU01B6AKH.19.53.E09.1.454.heavy.3.raw

SEQ ID NO: 448565 - DNA, 481 bp, Homo sapiens
  misc_feature: HEFZJCU01BYSAU.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgctggtcaaggactacttcctagagacacg

SEQ ID NO: 448566 - DNA, 324 bp, Homo sapiens; identical to SEQ ID NO: 444475
  misc_feature: HEFZJCU01DCIHV.18.17.B06.1.454.heavy.3.raw

SEQ ID NO: 448567 - DNA, 477 bp, Homo sapiens; identical to SEQ ID NO: 444659
  misc_feature: HEFZJCU01BKEYB.16.10.A10.1.454.heavy.3.raw

SEQ ID NO: 448568 - DNA, 394 bp, Homo sapiens
  misc_feature: HEFZJCU01CWHRX.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctgggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 448569 - DNA, 407 bp, Homo sapiens
  misc_feature: HEFZJCU01CJYBM.49.61.F06.1.454.heavy.3.raw
agtcgagagacacgaccggtgctcgatttagctacgctctaagggaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 448570 - DNA, 396 bp, Homo sapiens
  misc_feature: HEFZJCU01EYP2I.16.24.C02.1.454.heavy.3.raw
tgtactactccacgaccggtgctcgatttagtacagatcgttagggtaaggggtcgtggagtgggtctccaaggtattagtggtgttggtggtctcacatattacgcagactccgtgaagggccggttacaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 448571 - DNA, 479 bp, Homo sapiens; identical to SEQ ID NO: 447128
  misc_feature: HEFZJCU01DEL3E.4.37.D04.1.454.heavy.3.raw

SEQ ID NO: 448572 - DNA, 511 bp, Homo sapiens
  misc_feature: HEFZJCU01CVTMI.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccaatatattactgtgcgaaagcaccggcaagttgcacccatactactttgactactggggccg

SEQ ID NO: 448573 - DNA, 512 bp, Homo sapiens
  misc_feature: HEFZJCU01A29O4.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctggggccgtggcaccctggtcactgtctcctcggcttccaccaagggcccatcggtcttcccctggcgccctgctccaggagcacctctggggcacagcggcccg

SEQ ID NO: 448574 - DNA, 500 bp, Homo sapiens
  misc_feature: HEFZJCU01DZT2Z.16.34.D01.1.454.heavy.3.raw
tgtactactccacgaccggtgctcgatttagatcgtctgtgttgggtttgggggaggcttggtacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 448575 - DNA, 522 bp, Homo sapiens; identical to SEQ ID NO: 446788
  misc_feature: HEFZJCU01DGTA3.12.40.D07.1.454.heavy.3.raw

SEQ ID NO: 448576 - DNA, 526 bp, Homo sapiens
  misc_feature: HEFZJCU01B8AHG.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagcgtggagtttccttaggctgctattttaaaaggtgtccagtgtgaggtgcagctggtggagtctgggggaggcttggtaaagccgggggggtcccttagactcccctgtacagcctctggattcactttcagtaaggcctggatgaactggtccgccaggctccagggaaggggctggagtgggttggccgtattaaaccaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatcccctgaaagcgtacaactactactactacggtatggactc

SEQ ID NO: 448577 - DNA, 520 bp, Homo sapiens
  misc_feature: HEFZJCU01CXJ1Z.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgtaccttttctggtatttcgatctcgtggggccgtggcacctggtcactgtctcctcggcttccaccaagggcccatcggtccttcccctggccgccctgcctccaggacgcacctcgtggggcacaggccggccc

SEQ ID NO: 448578 - DNA, 535 bp, Homo sapiens
  misc_feature: HEFZJCU01CGSIE.52.15.B04.1.454.heavy.3.raw
cgcagtacgacacgaccggtgctcgatttagacagtatatatccgcgggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtattggatcgggggaaaattactaactccggtatggacgtctggggccaagggaccacggtcaccgtctcctcagcctccaccg

SEQ ID NO: 448579 - DNA, 509 bp, Homo sapiens; identical to SEQ ID NO: 447939
  misc_feature: HEFZJCU01BJ7G4.17.25.C03.1.454.heavy.3.raw

SEQ ID NO: 448580 - DNA, 373 bp, Homo sapiens
  misc_feature: HEFZJCU01D9VJN.3.42.D09.1.454.heavy.3.raw
agacgcactccacgaccggtgctcgatttagacacatacgcagggaagggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccggtctcctcagcctccaccaagggcccatcggtcttccccctggcaccctcctccaagagcacctccgagagcacagcggccctgggctgcctggtcaaggactacttccgagtgcgtct

SEQ ID NO: 448581 - DNA, 495 bp, Homo sapiens; identical to SEQ ID NO: 446556
  misc_feature: HEFZJCU01B0GKG.10.71.G05.1.454.heavy.3.raw

SEQ ID NO: 448582 - DNA, 515 bp, Homo sapiens
  misc_feature: HEFZJCU01EUDGQ.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagcttggtcaccgtctcctc

SEQ ID NO: 448583 - DNA, 375 bp, Homo sapiens; identical to SEQ ID NO: 444442
  misc_feature: HEFZJCU01EN4JD.48.23.C01.1.454.heavy.3.raw

SEQ ID NO: 448584 - DNA, 506 bp, Homo sapiens; identical to SEQ ID NO: 446520
  misc_feature: HEFZJCU01B58M4.10.38.D05.1.454.heavy.3.raw

SEQ ID NO: 448585 - DNA, 519 bp, Homo sapiens
  misc_feature: HEFZJCU01DWIKS.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggtcgcaacagactacggtggcaactcctatgcttttgatatctggggccaagggacaatggtcaccgtctcttcagcctccaccaagggcccatcggtcttccccctggccaccctcctcccaagagcacctctggggggcacagcggcccg

SEQ ID NO: 448586 - DNA, 495 bp, Homo sapiens
  misc_feature: HEFZJCU01DHEO7.53.78.H01.1.454.heavy.3.raw
cgcgtatacacacgaccggtgctcgatttagtgtgagtagtttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 448587 - DNA, 483 bp, Homo sapiens
  misc_feature: HEFZJCU01DYPI5.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctagaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctgggctgcctggtcaaggactacttccgtatctctcg

SEQ ID NO: 448588 - DNA, 507 bp, Homo sapiens
  misc_feature: HEFZJCU01DAQFZ.51.53.E09.1.454.heavy.3.raw
cgatcgtatacacgaccggtgctcgatttagagagagtgtgttgggtttggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctcgtacg

SEQ ID NO: 448589 - DNA, 509 bp, Homo sapiens
  misc_feature: HEFZJCU01AY2RQ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaaggcccatcggtcttcccctggcgccctgctccaggagcacctctgggggcacgagcggccctgggctgcctggtcaggactactcccatac

SEQ ID NO: 448590 - DNA, 384 bp, Homo sapiens; identical to SEQ ID NO: 444454
  misc_feature: HEFZJCU01BF09G.11.61.F06.1.454.heavy.3.raw

SEQ ID NO: 448591 - DNA, 501 bp, Homo sapiens
  misc_feature: HEFZJCU01ECHSJ.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgt

SEQ ID NO: 448592 - DNA, 482 bp, Homo sapiens; identical to SEQ ID NO: 444503
  misc_feature: HEFZJCU01CHQ4A.7.10.A10.1.454.heavy.3.raw

SEQ ID NO: 448593 - DNA, 530 bp, Homo sapiens
  misc_feature: HEFZJCU01EUDNF.8.10.A10.1.454.heavy.3.raw
ctcgcgtgtccacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtcttccccctggccaccctcctccaagagcacctctgggggcacagcggccctgggctgcctggtcaaggactacttccgacacgcgacg

SEQ ID NO: 448594 - DNA, 500 bp, Homo sapiens
  misc_feature: HEFZJCU01DQLNZ.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaattattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggacgcacctccgagagcacagcggccctgggctgcctggtcaaggactacttccgtactagacg

SEQ ID NO: 448595 - DNA, 502 bp, Homo sapiens; identical to SEQ ID NO: 444768
  misc_feature: HEFZJCU01DDL56.21.70.G04.1.454.heavy.3.raw

SEQ ID NO: 448596 - DNA, 383 bp, Homo sapiens
  misc_feature: HEFZJCU01A47W7.9.46.E02.1.454.heavy.3.raw
tgatacgtctcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccagacgtatca

SEQ ID NO: 448597 - DNA, 503 bp, Homo sapiens; identical to SEQ ID NO: 445995
  misc_feature: HEFZJCU01D4LNN.17.25.C03.1.454.heavy.3.raw

SEQ ID NO: 448598 - DNA, 483 bp, Homo sapiens; identical to SEQ ID NO: 444932
  misc_feature: HEFZJCU01DU73J.7.10.A10.1.454.heavy.3.raw

SEQ ID NO: 448599 - DNA, 500 bp, Homo sapiens; identical to SEQ ID NO: 445080
  misc_feature: HEFZJCU01A85I0.3.81.H04.1.454.heavy.3.raw

SEQ ID NO: 448600 - DNA, 400 bp, Homo sapiens
  misc_feature: HEFZJCU01EGYSO.47.24.C02.1.454.heavy.3.raw
agctcacgtacacgaccggtgctcgatttagtacagatcgttagggaaagggactggagtggattggctatgttcatttcagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 448601 - DNA, 505 bp, Homo sapiens; identical to SEQ ID NO: 444759
  misc_feature: HEFZJCU01BYO29.10.38.D05.1.454.heavy.3.raw

SEQ ID NO: 448602 - DNA, 519 bp, Homo sapiens
  misc_feature: HEFZJCU01BUG6M.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacaacgctgtttctgtcaaatgaacagcctgagagctgaggacacggctgtgtattactgttcgtttggttctgtactcgtcgggggaataccttcagcactgggccgac

SEQ ID NO: 448603 - DNA, 339 bp, Homo sapiens; identical to SEQ ID NO: 444436
  misc_feature: HEFZJCU01A40QN.47.38.D05.1.454.heavy.3.raw

SEQ ID NO: 448604 - DNA, 487 bp, Homo sapiens; identical to SEQ ID NO: 446769
  misc_feature: HEFZJCU01B7ZYH.22.86.H09.1.454.heavy.3.raw

SEQ ID NO: 448605 - DNA, 400 bp, Homo sapiens
  misc_feature: HEFZJCU01DMYWM.47.24.C02.1.454.heavy.3.raw
agctcacgtacacgaccggtgctcgatttagtacagatcgttagggaaagggactggagtggattggctatgttcattccagtgggagcaccgactataacctctccctcaagggtagagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 448606 - DNA, 339 bp, Homo sapiens; identical to SEQ ID NO: 444436
  misc_feature: HEFZJCU01DYI1F.47.38.D05.1.454.heavy.3.raw

SEQ ID NO: 448607 - DNA, 518 bp, Homo sapiens; identical to SEQ ID NO: 445810
  misc_feature: HEFZJCU01BCIS4.2.11.A11.1.454.heavy.3.raw

SEQ ID NO: 448608 - DNA, 518 bp, Homo sapiens; identical to SEQ ID NO: 444718
  misc_feature: HEFZJCU01BUCIW.9.34.D01.1.454.heavy.3.raw

SEQ ID NO: 448609 - DNA, 519 bp, Homo sapiens; identical to SEQ ID NO: 445617
  misc_feature: HEFZJCU01EQL2H.9.34.D01.1.454.heavy.3.raw

SEQ ID NO: 448610 - DNA, 490 bp, Homo sapiens
  misc_feature: HEFZJCU01DZ3C1.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttctaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcattgaacagcctgagagccgaggacacggccgtataattactgtgcgaaagatttggggaatgacc

SEQ ID NO: 448611 - DNA, 396 bp, Homo sapiens; identical to SEQ ID NO: 445149
  misc_feature: HEFZJCU01AREQL.18.31.C09.1.454.heavy.3.raw

SEQ ID NO: 448612 - DNA, 516 bp, Homo sapiens
  misc_feature: HEFZJCU01D8IF6.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttcccctggcaccctcctccaagagcacctctgggggcacagcggccctgggctgcctggtcaaggactacttccagacgtatc

SEQ ID NO: 448613 - DNA, 492 bp, Homo sapiens
  misc_feature: HEFZJCU01DMK3G.52.37.D04.1.454.heavy.3.raw
cgcagtacgacacgaccggtgctcgatttagtagcatactgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttctggggccagggaacccgggtcaccgtctcctcagcctccaccaaggcccatcggtcttcccctggcaccctcctccaagagcacctctgggggcacagcggccctgggctgcctggtcaaggactacttcctatacgatcg

SEQ ID NO: 448614 - DNA, 381 bp, Homo sapiens; identical to SEQ ID NO: 445431
  misc_feature: HEFZJCU01BBF07.3.70.G04.1.454.heavy.3.raw

SEQ ID NO: 448615 - DNA, 509 bp, Homo sapiens
  misc_feature: HEFZJCU01DEQ2S.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactgggccagggaaccctggtcgccg

SEQ ID NO: 448616 - DNA, 530 bp, Homo sapiens
  misc_feature: HEFZJCU01BQC9M.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaacccgtggtcaccgtctccccaccctccaccg

SEQ ID NO: 448617 - DNA, 510 bp, Homo sapiens
  misc_feature: HEFZJCU01EYSAR.9.12.B01.1.454.heavy.3.raw
tgatacgtctcacgaccggtgctcgatttagtagtgtagattccgcgggggctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccaaggga

SEQ ID NO: 448618 - DNA, 521 bp, Homo sapiens; identical to SEQ ID NO: 445317
  misc_feature: HEFZJCU01CDZMJ.12.40.D07.1.454.heavy.3.raw

SEQ ID NO: 448619 - DNA, 396 bp, Homo sapiens; identical to SEQ ID NO: 444469
  misc_feature: HEFZJCU01EA0PR.47.46.E02.1.454.heavy.3.raw

SEQ ID NO: 448620 - DNA, 500 bp, Homo sapiens
  misc_feature: HEFZJCU01BRXM3.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagtcccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 448621 - DNA, 491 bp, Homo sapiens
  misc_feature: HEFZJCU01CA79I.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtatcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 448622 - DNA, 413 bp, Homo sapiens
  misc_feature: HEFZJCU01CZ6OJ.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctcggcaccctcctccaagagcacctctgggggcacagcggccctgggctgcctggtcaaggactacttcctcgtagcact

SEQ ID NO: 448623 - DNA, 467 bp, Homo sapiens
  misc_feature: HEFZJCU01EFWPJ.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 448624 - DNA, 504 bp, Homo sapiens
  misc_feature: HEFZJCU01DSTC5.51.85.H08.1.454.heavy.3.raw
cgatcgtatacacgaccggtgctcgatttagtatcactcagtcgcgggagctctgggagaggagaccagcactagaagtcggcggtgtttccattcggtgatcagcactgaacacagaggtctcaccatggagtttgggctgcgctggattttcctcgttgctctttttagaggtgcccagtgtcagatacaactggtggagtcggggggaggcgtggtccagcctggggggtccctgagagtctcgtgtgcagcctctggattcaccttcaggcgttacggcatgaactgggtccgccaggctccaggcaaggggctggagtgggtggctgtcataacatttgatggaactaagaaatattatgcagactccgtgaagggccgattcaccatctccagagacaattcaaaggacaccctatatttagaaatgagcagcctgagacctgcggacacggctgtgtattactgtgcgaaagagtgggggaagttagtttctatgat

SEQ ID NO: 448625 - DNA, 537 bp, Homo sapiens
  misc_feature: HEFZJCU01B4FFG.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggccatcggtcttcccctggcaccctcctccaagagcacctctgggggcacagcc

SEQ ID NO: 448626 - DNA, 506 bp, Homo sapiens; identical to SEQ ID NO: 444696
  misc_feature: HEFZJCU01ET7V8.16.34.D01.1.454.heavy.3.raw

SEQ ID NO: 448627 - DNA, 407 bp, Homo sapiens
  misc_feature: HEFZJCU01ASHEI.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgt

SEQ ID NO: 448628 - DNA, 519 bp, Homo sapiens
  misc_feature: HEFZJCU01CZAZ5.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggcagggaaccctggtgaccgtctcctcagcctccaccaagggcccatcggtcttcccctggcgccctgctccaggagcacctccgagagcacacgcggccc

SEQ ID NO: 448629 - DNA, 501 bp, Homo sapiens; identical to SEQ ID NO: 445341
  misc_feature: HEFZJCU01E0F6O.48.34.D01.1.454.heavy.3.raw

SEQ ID NO: 448630 - DNA, 397 bp, Homo sapiens
  misc_feature: HEFZJCU01EKAVA.12.72.G06.1.454.heavy.3.raw
atacgacgtacacgaccggtgctcgatttagctacgactgcaagggaaaggggctggagtgggtctcaggtattagtggaagtggagcaaccacatactacgcagactccgtaaagggccgattcaccatctccagagacaataccaacaacactctgtatctgcaactgaacggcctgagagccgaggacacggccctttattactgtgtgaaagatcgggtaactttagcagcggctggttactttgactactggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 448631 - DNA, 527 bp, Homo sapiens
  misc_feature: HEFZJCU01ES2VZ.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaagtggacagcctaagagttgaggacacggctgtttattactgtacgaaagagggggatacagtggcagctccaagtactactttgacttctgggccagggaaccctggtcaccgtctcctcagcctccaccaaggcccatcggtcttcccctggcgccctgctccaggacgcacctccgagacg

SEQ ID NO: 448632 - DNA, 339 bp, Homo sapiens; identical to SEQ ID NO: 444436
  misc_feature: HEFZJCU01CCM2J.47.38.D05.1.454.heavy.3.raw

SEQ ID NO: 448633 - DNA, 505 bp, Homo sapiens; identical to SEQ ID NO: 444759
  misc_feature: HEFZJCU01BNHQ0.10.38.D05.1.454.heavy.3.raw

SEQ ID NO: 448634 - DNA, 395 bp, Homo sapiens; identical to SEQ ID NO: 444517
  misc_feature: HEFZJCU01BZHZ9.16.68.G02.1.454.heavy.3.raw

SEQ ID NO: 448635 - DNA, 518 bp, Homo sapiens
  misc_feature: HEFZJCU01DUARK.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaaggcccatcggtcttcccctggcaccctcctccaagagcacctctgggggcacagcggccctgggctgcctggtcaaggactacttcctatacgta

SEQ ID NO: 448636 - DNA, 513 bp, Homo sapiens
  misc_feature: HEFZJCU01DH6UU.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttccccctggccgccctgctccaggagcacctccgagagcacagcggccctgggctgcctggtcaaggactacttccgagt

SEQ ID NO: 448637 - DNA, 490 bp, Homo sapiens; identical to SEQ ID NO: 444500
  misc_feature: HEFZJCU01DEONM.19.53.E09.1.454.heavy.3.raw

SEQ ID NO: 448638 - DNA, 506 bp, Homo sapiens
  misc_feature: HEFZJCU01DLVLY.12.55.E11.1.454.heavy.3.raw
  modified_base (436)..(436): a, c, t, g, unknown or other
atacgacgtacacgaccggtgctcgatttagcactcgcacgttgggtttgggctgagcgtgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctgggccgtggcnccctggtcactgtctcctcggcttccaccagggcccatcggtccttccccctggccgccctcgctccagg

SEQ ID NO: 448639 - DNA, 400 bp, Homo sapiens; identical to SEQ ID NO: 444452
  misc_feature: HEFZJCU01CMCO9.47.24.C02.1.454.heavy.3.raw

SEQ ID NO: 448640 - DNA, 466 bp, Homo sapiens; identical to SEQ ID NO: 445835
  misc_feature: HEFZJCU01BYNJX.9.34.D01.1.454.heavy.3.raw

SEQ ID NO: 448641 - DNA, 324 bp, Homo sapiens
  misc_feature: HEFZJCU01AXFVG.48.34.D01.1.454.heavy.3.raw
agtatacatacacgaccggtgctcgatttagatcgtctgtgttgggtttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttgggccagggatacctggtcaccgtctcctcagcttccaccaagggcccatcggtcttccccctggcgccctgctccaggagcacctctgggggcacagcggccctgggctgcctggtcaaggactacttcctatgtatact

SEQ ID NO: 448642 - DNA, 524 bp, Homo sapiens
  misc_feature: HEFZJCU01EB4VE.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttcccctggcaccctcctccaagagcacctctgggggcacagcc

SEQ ID NO: 448643 - DNA, 519 bp, Homo sapiens
  misc_feature: HEFZJCU01CIG51.9.34.D01.1.454.heavy.3.raw
tgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 448644 - DNA, 450 bp, Homo sapiens; identical to SEQ ID NO: 444893
  misc_feature: HEFZJCU01BLVYY.53.57.F02.1.454.heavy.3.raw

SEQ ID NO: 448645 - DNA, 494 bp, Homo sapiens
  misc_feature: HEFZJCU01DV6YP.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagtactg

SEQ ID NO: 448646 - DNA, 400 bp, Homo sapiens; identical to SEQ ID NO: 447616
  misc_feature: HEFZJCU01APW4H.4.77.G11.1.454.heavy.3.raw

SEQ ID NO: 448647 - DNA, 493 bp, Homo sapiens
  misc_feature: HEFZJCU01EQOL4.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgaggagaggacccgatgacctc

SEQ ID NO: 448648 - DNA, 508 bp, Homo sapiens
  misc_feature: HEFZJCU01EBMLG.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttcccctggcaccctcctccaagagcacctctgggggcacagcggccctggggctg

SEQ ID NO: 448649 - DNA, 379 bp, Homo sapiens; identical to SEQ ID NO: 444450
  misc_feature: HEFZJCU01AR8NQ.47.77.G11.1.454.heavy.3.raw

SEQ ID NO: 448650 - DNA, 480 bp, Homo sapiens; identical to SEQ ID NO: 446171
  misc_feature: HEFZJCU01C1S0D.22.36.D03.1.454.heavy.3.raw

SEQ ID NO: 448651 - DNA, 400 bp, Homo sapiens; identical to SEQ ID NO: 447616
  misc_feature: HEFZJCU01CNXOA.4.77.G11.1.454.heavy.3.raw

SEQ ID NO: 448652 - DNA, 498 bp, Homo sapiens
  misc_feature: HEFZJCU01B68IB.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccagggaaccctggtcaccgtctcctcagcctccaaccg

SEQ ID NO: 448653 - DNA, 518 bp, Homo sapiens
  misc_feature: HEFZJCU01EE9SN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggccaagggaccg

SEQ ID NO: 448654 - DNA, 530 bp, Homo sapiens
  misc_feature: HEFZJCU01BNA3L.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccactatgcccaggccttcacagggcggtttgtcttctccatggatacctctgtcgggacggcttatctgcagataaccaaccttcaacctgacgacactgccgtttattttgtacgagagcgtcgtctgtcagtggaattgactacgtgggccagggaaccctggtcaccgtctcctcagcctccaccaaggg

SEQ ID NO: 448655 - DNA, 324 bp, Homo sapiens; identical to SEQ ID NO: 444475
  misc_feature: HEFZJCU01D9KD7.18.17.B06.1.454.heavy.3.raw

SEQ ID NO: 448656 - DNA, 506 bp, Homo sapiens; identical to SEQ ID NO: 446520
  misc_feature: HEFZJCU01B5VYW.10.38.D05.1.454.heavy.3.raw

SEQ ID NO: 448657 - DNA, 516 bp, Homo sapiens
  misc_feature: HEFZJCU01CC4F6.49.6.A06.1.454.heavy.3.raw
agtcgagagacacgaccggtgctcgatttagatctactgacaggggagctctgagagaggagcccagccctgggattttcaggtgttttcatttggtgatcaggactgagcagagagaactcaccatggagtttgggctgagcgtggcgttttcttaggtggctattttaaaaggtgtccagtgtgaggtgcagctggtggactctgggggaggcttggtacagcctggggggtccctgagactctcctgtgtagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtgcgaaagttcgcgtgctaggtacatttgactacgtgggccaac

SEQ ID NO: 448658 - DNA, 477 bp, Homo sapiens; identical to SEQ ID NO: 444659
  misc_feature: HEFZJCU01ETXXH.16.10.A10.1.454.heavy.3.raw

SEQ ID NO: 448659 - DNA, 517 bp, Homo sapiens; identical to SEQ ID NO: 446608
  misc_feature: HEFZJCU01B267E.9.34.D01.1.454.heavy.3.raw

SEQ ID NO: 448660 - DNA, 375 bp, Homo sapiens
  misc_feature: HEFZJCU01APOPT.13.59.F04.1.454.heavy.3.raw
tcacgtactacacgaccggtgctcgatttagtacacacacttagggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccaggagcacctccgagagcacagcggccctgggctgcctggtcaaggactacttcctagtacgtga

SEQ ID NO: 448661 - DNA, 517 bp, Homo sapiens
  misc_feature: HEFZJCU01EEKLC.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagttttatggcgatggctgggtggacagatcactgggggccaac

SEQ ID NO: 448662 - DNA, 491 bp, Homo sapiens; identical to SEQ ID NO: 444592
  misc_feature: HEFZJCU01BII8H.11.26.C04.1.454.heavy.3.raw

SEQ ID NO: 448663 - DNA, 517 bp, Homo sapiens
  misc_feature: HEFZJCU01DWXMR.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggccatcggtcttcccctggcaccctcctccaagagcacctctgggggcacagcggccctgggctgcctggtcaaggactacttcctagagacacg

SEQ ID NO: 448664 - DNA, 511 bp, Homo sapiens
  misc_feature: HEFZJCU01CN283.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaacgggcccatcggtcttccccctcggcaccctcctccaagagcacctctggggcacagcggcctgggctgcctggtcaggactacttccgtactacg

SEQ ID NO: 448665 - DNA, 498 bp, Homo sapiens
  misc_feature: HEFZJCU01A09RD.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtgggtggtacctgcttactttttc

SEQ ID NO: 448666 - DNA, 494 bp, Homo sapiens
  misc_feature: HEFZJCU01D09DK.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggacacttccgagagtaca

SEQ ID NO: 448667 - DNA, 396 bp, Homo sapiens; identical to SEQ ID NO: 444469
  misc_feature: HEFZJCU01EEYY2.47.46.E02.1.454.heavy.3.raw

SEQ ID NO: 448668 - DNA, 516 bp, Homo sapiens
  misc_feature: HEFZJCU01D700H.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccc

SEQ ID NO: 448669 - DNA, 400 bp, Homo sapiens; identical to SEQ ID NO: 444452
  misc_feature: HEFZJCU01B86UP.47.24.C02.1.454.heavy.3.raw

SEQ ID NO: 448670 - DNA, 510 bp, Homo sapiens
  misc_feature: HEFZJCU01BUE30.18.39.D06.1.454.heavy.3.raw
  modified_base (455)..(455): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggngcacctctgggggcacagcggccctgggctgcctggtcaaggactacttcccata

SEQ ID NO: 448671 - DNA, 398 bp, Homo sapiens
  misc_feature: HEFZJCU01CYO3M.47.60.F05.1.454.heavy.3.raw
agctcacgtacacgaccggtgctcgatttagtacgtcatcagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 448672 - DNA, 488 bp, Homo sapiens
  misc_feature: HEFZJCU01DP2QH.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattatttgtgcccttgattacta

SEQ ID NO: 448673 - DNA, 432 bp, Homo sapiens; identical to SEQ ID NO: 445970
  misc_feature: HEFZJCU01ADAYG.53.65.F10.1.454.heavy.3.raw

SEQ ID NO: 448674 - DNA, 490 bp, Homo sapiens
  misc_feature: HEFZJCU01DJRHE.14.25.C03.1.454.heavy.3.raw
  modified_base (476)..(476): a, c, t, g, unknown or other
cgtctagtaccacgaccggtgctcgatttagtagtgtagatttgggtttggggagacgagcccagcactggaagtcgccggtgtttccattcgatgatcagcactgaacacagaggactcaccatggagtttgggctgagcggtggtttcgtcgtaggctctttaagtaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatgacgctatgccgactccgtgaagggccgattcaccatctccagagacaattccaagaacacgcagtatctgcaaatgaacagcctgagagctgaggcacggctgtggtattatgtgggagaganggaggtcgaatatt

SEQ ID NO: 448675 - DNA, 494 bp, Homo sapiens
  misc_feature: HEFZJCU01EITMS.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtggtttcgtcgttaggctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcatatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgta

SEQ ID NO: 448676 - DNA, 522 bp, Homo sapiens
  misc_feature: HEFZJCU01ED13Z.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattctaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttattacaattctggtaccacatactactccgaccccgtgaagggccgattaacccatctccagagacgattccgagaacacggtgtatcttcaaatgaacaacctgagagccgacgacacggccgtttattactgtgcgagagatcgagtggttcggggacctcaccctggttctacttcgatctctcggggccgt

SEQ ID NO: 448677 - DNA, 396 bp, Homo sapiens; identical to SEQ ID NO: 444568
  misc_feature: HEFZJCU01DEPT3.47.46.E02.1.454.heavy.3.raw

SEQ ID NO: 448678 - DNA, 481 bp, Homo sapiens
  misc_feature: HEFZJCU01EJ99K.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttctagagacacg

SEQ ID NO: 448679 - DNA, 484 bp, Homo sapiens
  misc_feature: HEFZJCU01A53R4.10.35.D02.1.454.heavy.3.raw
catagtagtgcacgaccggtgctcgatttagcacacgataggttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 448680 - DNA, 531 bp, Homo sapiens
  misc_feature: HEFZJCU01AS29J.48.73.G07.1.454.heavy.3.raw
agtatacatacacgaccggtgctcgatttagctctacgctcagggcacgaccggtgctcgatttagctctacgctcagggcgacgaccggtgctcgatttagcacacgatagttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactgggggccagggaacccgtggtccaccgtctccctccagcctccaccaacgggcccactcggtcttccccctggccgccctcg

SEQ ID NO: 448681 - DNA, 508 bp, Homo sapiens; identical to SEQ ID NO: 444619
  misc_feature: HEFZJCU01EFSTX.3.81.H04.1.454.heavy.3.raw

SEQ ID NO: 448682 - DNA, 491 bp, Homo sapiens; identical to SEQ ID NO: 446104
  misc_feature: HEFZJCU01DY8M7.3.34.D01.1.454.heavy.3.raw

SEQ ID NO: 448683 - DNA, 390 bp, Homo sapiens
  misc_feature: HEFZJCU01C6BF3.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 448684 - DNA, 396 bp, Homo sapiens
  misc_feature: HEFZJCU01CU6IM.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaagagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 448685 - DNA, 481 bp, Homo sapiens
  misc_feature: HEFZJCU01BVUKS.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggcctgggctgcctggtcaaggactacttcctagagacacg

SEQ ID NO: 448686 - DNA, 483 bp, Homo sapiens; identical to SEQ ID NO: 444924
  misc_feature: HEFZJCU01CGD25.10.35.D02.1.454.heavy.3.raw

SEQ ID NO: 448687 - DNA, 510 bp, Homo sapiens
  misc_feature: HEFZJCU01DNVLO.18.39.D06.1.454.heavy.3.raw
  modified_base (454)..(454): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccnggagcacctctggggcacagcggcctcgggctgcctggtcaggactacttcccata

SEQ ID NO: 448688 - DNA, 423 bp, Homo sapiens
  misc_feature: HEFZJCU01BLWRY.51.45.E01.1.454.heavy.3.raw
cgatcgtatacacgaccggtgctcgatttagtgagtcagtaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 448689 - DNA, 508 bp, Homo sapiens
  misc_feature: HEFZJCU01CNENY.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattggtgcgaaagacgtatgtagtggtgactgcttgtttggagcttttgactactggggccagggaaccctggtcatcgtctcctcagcctccaccaagggcccatcggtcttccccctggtaccctcctccaagagcacctctgggggcacagcggccctgggctgcctggtcaaggactacttccgagtagtaca

SEQ ID NO: 448690 - DNA, 533 bp, Homo sapiens
  misc_feature: HEFZJCU01EBUMT.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagtttgggctgagctggattttccttgctgctattttaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgacccctgggggccggggaaccctgggtccaccggtcctccccgaccctccc

SEQ ID NO: 448691 - DNA, 508 bp, Homo sapiens; identical to SEQ ID NO: 446002
  misc_feature: HEFZJCU01ECTGB.9.78.H01.1.454.heavy.3.raw

SEQ ID NO: 448692 - DNA, 427 bp, Homo sapiens; identical to SEQ ID NO: 444708
  misc_feature: HEFZJCU01ANIE7.9.34.D01.1.454.heavy.3.raw

SEQ ID NO: 448693 - DNA, 330 bp, Homo sapiens; identical to SEQ ID NO: 445264
  misc_feature: HEFZJCU01CX73B.53.44.D11.1.454.heavy.3.raw

SEQ ID NO: 448694 - DNA, 534 bp, Homo sapiens
  misc_feature: HEFZJCU01CORLC.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgtatttttggagttggccttgataaacgtgggggccgagggggatccgtggtcaccgtctcctcacgcctccaccaac

SEQ ID NO: 448695 - DNA, 510 bp, Homo sapiens
  misc_feature: HEFZJCU01EKWJ2.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggagcacctctgggggcacagcggccctgggctgcctggtcaggactacttcccatac

SEQ ID NO: 448696 - DNA, 511 bp, Homo sapiens
  misc_feature: HEFZJCU01EN0DW.16.71.G05.1.454.heavy.3.raw
  modified_base (135)..(135): a, c, t, g, unknown or other
tgtactactccacgaccggtgctcgatttagtgtcgtcgcaagagagaggggcccagccctgggattttcaggtgttttcatttggtgatcaggactgaacagagagaactcaccatggagtctgggctgagcgngtcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccac

SEQ ID NO: 448697 - DNA, 394 bp, Homo sapiens; identical to SEQ ID NO: 446347
  misc_feature: HEFZJCU01CAQGF.52.41.D08.1.454.heavy.3.raw

SEQ ID NO: 448698 - DNA, 506 bp, Homo sapiens; identical to SEQ ID NO: 444696
  misc_feature: HEFZJCU01CB2LT.16.34.D01.1.454.heavy.3.raw

SEQ ID NO: 448699 - DNA, 502 bp, Homo sapiens
  misc_feature: HEFZJCU01DCKXQ.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgtt

SEQ ID NO: 448700 - DNA, 522 bp, Homo sapiens
  misc_feature: HEFZJCU01DFZ9R.10.85.H08.1.454.heavy.3.raw
catagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactacttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctgcgcctgctccaggagcacctccgagagcacagcggccctgggctgcctggtcaaggactactccactactatg

SEQ ID NO: 448701 - DNA, 512 bp, Homo sapiens
  misc_feature: HEFZJCU01BYJWQ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcaccctcctccaagagcacctctgggggcacagcggcctgggctgcctggtcaaggactactccatactcg

SEQ ID NO: 448702 - DNA, 539 bp, Homo sapiens
  misc_feature: HEFZJCU01DACNW.49.67.G01.1.454.heavy.3.raw
agtcgagagacacgaccggtgctcgatttagagtatacatattgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggtttggatgactcttacttctacttctacgttatggacctctggggccaagggaccacggtcaccgtctcctcagcctccaccaagggcccatcggtcttccccctggcaccctcctccaagagcacctctgggggcacagcggccc

SEQ ID NO: 448703 - DNA, 313 bp, Homo sapiens; identical to SEQ ID NO: 444428
  misc_feature: HEFZJCU01AID4I.11.59.F04.1.454.heavy.3.raw

SEQ ID NO: 448704 - DNA, 501 bp, Homo sapiens; identical to SEQ ID NO: 445027
  misc_feature: HEFZJCU01B0S9W.26.23.C01.1.454.heavy.3.raw

SEQ ID NO: 448705 - DNA, 535 bp, Homo sapiens
  misc_feature: HEFZJCU01A7KS7.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccg

SEQ ID NO: 448706 - DNA, 395 bp, Homo sapiens
  misc_feature: HEFZJCU01D86CO.18.61.F06.1.454.heavy.3.raw
tacgagtatgcacgaccggtgctcgatttagctacgctctaagggaaaggggctggagtggttgagttttatatcatatgatggaggttacaaatattatgcagagtccgtgaagggccgattcatcatctccagagacaactccaagaacacactgtttctgcaagtggacagtctgagacctgaggacacggctgtatattactgtacgagagatccggggggtcacgaccactggaactactttaccttctggggccagggaaccctggtcatcgtctcctcagcctccaccaagggcccatcggtcttccccctggcgccctgctccaggagcacctccgagagcacagcggccctgggctgcctggtcaaggactacttcccatactgta

SEQ ID NO: 448707 - DNA, 384 bp, Homo sapiens; identical to SEQ ID NO: 444492
  misc_feature: HEFZJCU01C90WR.18.60.F05.1.454.heavy.3.raw

SEQ ID NO: 448708 - DNA, 500 bp, Homo sapiens; identical to SEQ ID NO: 445720
  misc_feature: HEFZJCU01B4HCZ.3.20.B09.1.454.heavy.3.raw

SEQ ID NO: 448709 - DNA, 454 bp, Homo sapiens
  misc_feature: HEFZJCU01DWRVV.40.57.F02.1.454.heavy.3.raw
tctagcgactcacgaccggtgctcgatttagctcgatatagttgggtttgggattcacgttgcagatgtagggctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 448710 - DNA, 397 bp, Homo sapiens
  misc_feature: HEFZJCU01EPQQY.7.60.F05.1.454.heavy.3.raw
cgtgtctctacacgaccggtgctcgatttagtacgtcatcaggctccagggaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttcccctggcgccctgctccaggagcacctccgagagcacagcggccctgggctgcctggtcaaggactacttcctagagacacg

SEQ ID NO: 448711 - DNA, 511 bp, Homo sapiens; identical to SEQ ID NO: 446224
  misc_feature: HEFZJCU01BUH8Z.7.28.C06.1.454.heavy.3.raw

SEQ ID NO: 448712 - DNA, 500 bp, Homo sapiens; identical to SEQ ID NO: 445720
  misc_feature: HEFZJCU01BDTMS.3.20.B09.1.454.heavy.3.raw

SEQ ID NO: 448713 - DNA, 470 bp, Homo sapiens; identical to SEQ ID NO: 444866
  misc_feature: HEFZJCU01DRNLF.4.36.D03.1.454.heavy.3.raw

SEQ ID NO: 448714 - DNA, 496 bp, Homo sapiens; identical to SEQ ID NO: 444697
  misc_feature: HEFZJCU01C1UGL.16.37.D04.1.454.heavy.3.raw

SEQ ID NO: 448715 - DNA, 509 bp, Homo sapiens; identical to SEQ ID NO: 444586
  misc_feature: HEFZJCU01C8YGD.12.78.H01.1.454.heavy.3.raw

SEQ ID NO: 448716 - DNA, 505 bp, Homo sapiens
  misc_feature: HEFZJCU01C96KG.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttcgagtagtaca

SEQ ID NO: 448717 - DNA, 383 bp, Homo sapiens; identical to SEQ ID NO: 444673
  misc_feature: HEFZJCU01AZRKL.11.61.F06.1.454.heavy.3.raw

SEQ ID NO: 448718 - DNA, 507 bp, Homo sapiens; identical to SEQ ID NO: 446637
  misc_feature: HEFZJCU01A0PV8.16.34.D01.1.454.heavy.3.raw

SEQ ID NO: 448719 - DNA, 488 bp, Homo sapiens
  misc_feature: HEFZJCU01EW91K.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctgggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 448720 - DNA, 487 bp, Homo sapiens; identical to SEQ ID NO: 447190
  misc_feature: HEFZJCU01A053J.3.48.E04.1.454.heavy.3.raw

SEQ ID NO: 448721 - DNA, 500 bp, Homo sapiens
  misc_feature: HEFZJCU01CTSP8.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgctttgatatgtgggccaagggacac

SEQ ID NO: 448722 - DNA, 468 bp, Homo sapiens
  misc_feature: HEFZJCU01CA6UP.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 448723 - DNA, 351 bp, Homo sapiens; identical to SEQ ID NO: 446841
  misc_feature: HEFZJCU01AK30B.13.23.C01.1.454.heavy.3.raw

SEQ ID NO: 448724 - DNA, 374 bp, Homo sapiens
  misc_feature: HEFZJCU01CU9L7.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccgtatattattgtataggttatggtggtaattcgggcccctggggccagggaaccgtggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 448725 - DNA, 501 bp, Homo sapiens; identical to SEQ ID NO: 447719
  misc_feature: HEFZJCU01BTPEG.17.10.A10.1.454.heavy.3.raw

SEQ ID NO: 448726 - DNA, 512 bp, Homo sapiens
  misc_feature: HEFZJCU01DKHEQ.9.64.F09.1.454.heavy.3.raw
tgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagataaaaagtggggaccagggaaccctggtcaccgtctcct

SEQ ID NO: 448727 - DNA, 398 bp, Homo sapiens; identical to SEQ ID NO: 444524
  misc_feature: HEFZJCU01AFQGQ.7.60.F05.1.454.heavy.3.raw

SEQ ID NO: 448728 - DNA, 488 bp, Homo sapiens
  misc_feature: HEFZJCU01BNJN7.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgagttcatcatctccagagacaactccaacaacacactggatctccaaatgaacagcctgagagtcgaggacacggccgtatattattgtgcccttgattacta

SEQ ID NO: 448729 - DNA, 497 bp, Homo sapiens
  misc_feature: HEFZJCU01BSEC3.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacggtggtttggggctactggggccagggaaccctggtcaccgtctcctcagcctccaccg

SEQ ID NO: 448730 - DNA, 477 bp, Homo sapiens; identical to SEQ ID NO: 444659
  misc_feature: HEFZJCU01DTO3I.16.10.A10.1.454.heavy.3.raw

SEQ ID NO: 448731 - DNA, 517 bp, Homo sapiens
  misc_feature: HEFZJCU01B4XNT.11.25.C03.1.454.heavy.3.raw
cgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaa

SEQ ID NO: 448732 - DNA, 397 bp, Homo sapiens
  misc_feature: HEFZJCU01AX7QM.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccgacagcctccaccaagggcccatcggtcttccccctggcgccctgctccaggagcacctccgagagcacagcggccctgggctgcctggtcaaggactacttcctacgtgagct

SEQ ID NO: 448733 - DNA, 506 bp, Homo sapiens; identical to SEQ ID NO: 445682
  misc_feature: HEFZJCU01DZZ2N.48.44.D11.1.454.heavy.3.raw

SEQ ID NO: 448734 - DNA, 323 bp, Homo sapiens; identical to SEQ ID NO: 444416
  misc_feature: HEFZJCU01B8KMS.47.38.D05.1.454.heavy.3.raw

SEQ ID NO: 448735 - DNA, 528 bp, Homo sapiens
  misc_feature: HEFZJCU01CB1K1.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctgggtcaccgtctcctcagcctccaccaagggcccatcggtcttcccctggcgccctgctccaggagcacctccgagacg

SEQ ID NO: 448736 - DNA, 495 bp, Homo sapiens
  misc_feature: HEFZJCU01EOY6J.16.37.D04.1.454.heavy.3.raw
tgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 448737 - DNA, 515 bp, Homo sapiens
  misc_feature: HEFZJCU01CSMPI.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccacagactccgtgaggggccgattcaccatctccagagacaattccaagaacacgctgtttcttcaaatgaacagcctgagagccgatgacacggccgtgtattactgtgcgagagatggggcccacgaacgttactacgctatggacgctgggcgaggaccg

SEQ ID NO: 448738 - DNA, 506 bp, Homo sapiens; identical to SEQ ID NO: 448313
  misc_feature: HEFZJCU01DRQYM.52.34.D01.1.454.heavy.3.raw

SEQ ID NO: 448739 - DNA, 504 bp, Homo sapiens
  misc_feature: HEFZJCU01C5893.52.70.G04.1.454.heavy.3.raw
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattactgtgcgagggtcggcacgctgacaacctcttacttctattcctacgctatggacgtctc

SEQ ID NO: 448740 - DNA, 481 bp, Homo sapiens; identical to SEQ ID NO: 446362
  misc_feature: HEFZJCU01ADHSW.19.67.G01.1.454.heavy.3.raw

SEQ ID NO: 448741 - DNA, 399 bp, Homo sapiens
  misc_feature: HEFZJCU01DXAJ1.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggcctgggctgcctggtcaaggactacttcctacgtgagct

SEQ ID NO: 448742 - DNA, 372 bp, Homo sapiens; identical to SEQ ID NO: 444513
  misc_feature: HEFZJCU01E1KS3.5.23.C01.1.454.heavy.3.raw

SEQ ID NO: 448743 - DNA, 486 bp, Homo sapiens
  misc_feature: HEFZJCU01BWPUP.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaaatgaacagccttagagacgacgacacggctgtgtattactgtgcgagagatccg

SEQ ID NO: 448744 - DNA, 488 bp, Homo sapiens
  misc_feature: HEFZJCU01DLCEO.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatccggtctcccctggcgccctgctccaggagcacctccgagagcacagcggccctgggctgcctggtcaaggactacttccctacagtgct

SEQ ID NO: 448745 - DNA, 530 bp, Homo sapiens
  misc_feature: HEFZJCU01B5NPK.48.25.C03.1.454.heavy.3.raw
agtatacatacacgaccggtgctcgatttagtagtgtagatttgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtccg

SEQ ID NO: 448746 - DNA, 520 bp, Homo sapiens
  misc_feature: HEFZJCU01CDP4S.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgcaaatgaacagcctgagagtcgacgacacggccgtatactactgtgcgagacagatgctgccgcctgtccgtggggccagggaaccctggtcaccgt

SEQ ID NO: 448747 - DNA, 501 bp, Homo sapiens
  misc_feature: HEFZJCU01DI191.51.71.G05.1.454.heavy.3.raw
cgatcgtatacacgaccggtgctcgatttagtgtcgtcgcaagagagagggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcagccctcgaagaacatcatgatggctttgatatctggggccaagggacaatggtcattgtctcttcagcctccaccaagggcccatcggtcttccccctggcaccctcctcccaagagcacctctgggggcacagcggccctggctgcctggtcaaggactacttcc

SEQ ID NO: 448748 - DNA, 547 bp, Homo sapiens
  misc_feature: HEFZJCU01DW1JP.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggtagtttgggctgaggctgggtttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtacttagacaggtggattacatttggggggagtttatcgcgaaacgggggggtaactacgtacggtt

SEQ ID NO: 448749 - DNA, 534 bp, Homo sapiens
  misc_feature: HEFZJCU01DCXFK.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaagacaaaacgtccgaagtcgttatcactttgactcctggggccagggaaccctggtcagcgtctcttcagcctccaccaagggcccatcggtcttcccctggccaccctcctccaagagcacctctgggggcacagcgccctgggctg

SEQ ID NO: 448750 - DNA, 390 bp, Homo sapiens; identical to SEQ ID NO: 444541
  misc_feature: HEFZJCU01EH0LM.16.24.C02.1.454.heavy.3.raw

SEQ ID NO: 448751 - DNA, 519 bp, Homo sapiens; identical to SEQ ID NO: 444867
  misc_feature: HEFZJCU01D0TQ5.9.34.D01.1.454.heavy.3.raw

SEQ ID NO: 448752 - DNA, 506 bp, Homo sapiens
  misc_feature: HEFZJCU01DIO84.48.34.D01.1.454.heavy.3.raw
agtatacatacacgaccggtgctcgatttagatcgtctgtgttgggtttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctcggcgccctgctccagagcacctccgagagcacagcgcccgtgggctgcctggtcaaggactacttcctatgtatact

SEQ ID NO: 448753 - DNA, 501 bp, Homo sapiens; identical to SEQ ID NO: 445341
  misc_feature: HEFZJCU01DHEW4.48.34.D01.1.454.heavy.3.raw

SEQ ID NO: 448754 - DNA, 502 bp, Homo sapiens
  misc_feature: HEFZJCU01CAV2F.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgcctgctccaggagcgacctccgagagcacagcggcccgtcgggccgtgcctcggtcaaggactacg

SEQ ID NO: 448755 - DNA, 498 bp, Homo sapiens; identical to SEQ ID NO: 445952
  misc_feature: HEFZJCU01EZT6I.11.71.G05.1.454.heavy.3.raw

SEQ ID NO: 448756 - DNA, 503 bp, Homo sapiens
  misc_feature: HEFZJCU01DMVFD.53.85.H08.1.454.heavy.3.raw
cgcgtatacacacgaccggtgctcgatttagtatcactcagtcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaaactatggtgactccgtgaagggccgattctccgtctccagagacaattccaagaacaccttgtatctgcaaatgaacagcctgagatatgaggacacggctctgtattactgtgcgaaagaaaggttactgtgaagagtggagtt

SEQ ID NO: 448757 - DNA, 508 bp, Homo sapiens; identical to SEQ ID NO: 444619
  misc_feature: HEFZJCU01DJXD1.3.81.H04.1.454.heavy.3.raw

SEQ ID NO: 448758 - DNA, 423 bp, Homo sapiens; identical to SEQ ID NO: 444772
  misc_feature: HEFZJCU01B9KNE.16.78.H01.1.454.heavy.3.raw

SEQ ID NO: 448759 - DNA, 316 bp, Homo sapiens; identical to SEQ ID NO: 444444
  misc_feature: HEFZJCU01D7HTM.47.56.F01.1.454.heavy.3.raw

SEQ ID NO: 448760 - DNA, 506 bp, Homo sapiens
  misc_feature: HEFZJCU01CM99Y.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctgcgccctgctccagg

SEQ ID NO: 448761 - DNA, 505 bp, Homo sapiens
  misc_feature: HEFZJCU01EA5Y0.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactacgtggggccagggaactctggtcacgtctccgcagcctcacc

SEQ ID NO: 448762 - DNA, 491 bp, Homo sapiens; identical to SEQ ID NO: 446104
  misc_feature: HEFZJCU01ES46N.3.34.D01.1.454.heavy.3.raw

SEQ ID NO: 448763 - DNA, 498 bp, Homo sapiens
  misc_feature: HEFZJCU01EERYY.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctggggcacagcggccctgggctgcctggtcaaggactacttcctacgtcgtat

SEQ ID NO: 448764 - DNA, 518 bp, Homo sapiens
  misc_feature: HEFZJCU01C2ET9.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgatgggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 448765 - DNA, 510 bp, Homo sapiens
  misc_feature: HEFZJCU01EMYGV.17.33.C11.1.454.heavy.3.raw
cgtagactagcacgaccggtgctcgatttagagtgagctcgttgggtttggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggccc

SEQ ID NO: 448766 - DNA, 397 bp, Homo sapiens; identical to SEQ ID NO: 444534
  misc_feature: HEFZJCU01BHXGL.18.1.A01.1.454.heavy.3.raw

SEQ ID NO: 448767 - DNA, 315 bp, Homo sapiens; identical to SEQ ID NO: 444422
  misc_feature: HEFZJCU01ERGK6.47.84.H07.1.454.heavy.3.raw

SEQ ID NO: 448768 - DNA, 506 bp, Homo sapiens; identical to SEQ ID NO: 445864
  misc_feature: HEFZJCU01DDVGQ.13.37.D04.1.454.heavy.3.raw

SEQ ID NO: 448769 - DNA, 409 bp, Homo sapiens; identical to SEQ ID NO: 444519
  misc_feature: HEFZJCU01C0DJR.3.41.D08.1.454.heavy.3.raw

SEQ ID NO: 448770 - DNA, 496 bp, Homo sapiens
  misc_feature: HEFZJCU01BJRIU.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagacttcgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 448771 - DNA, 517 bp, Homo sapiens
  misc_feature: HEFZJCU01EKJGN.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatccggtcttcccctggcaccctcctccaagagcacctctgggggcacagcggccctggctgcctggtcaaggactactcctagagacacg

SEQ ID NO: 448772 - DNA, 500 bp, Homo sapiens; identical to SEQ ID NO: 444864
  misc_feature: HEFZJCU01BJ792.9.30.C08.1.454.heavy.3.raw

SEQ ID NO: 448773 - DNA, 518 bp, Homo sapiens
  misc_feature: HEFZJCU01B3IQS.12.39.D06.1.454.heavy.3.raw
  modified_base (378)..(378): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagcctttcaggctgaggacactgccatttattactgtgcgagagaggggganagtggagtagaacgtaatacgggaaccgtttgactttgggcgaggaaccctggtcaccgtctcctcagcctccaccaggcccatcggtcttcccctggcaccctcctccagagcacctctggggcacagcggcctggctg

SEQ ID NO: 448774 - DNA, 415 bp, Homo sapiens
  misc_feature: HEFZJCU01DHG8O.51.77.G11.1.454.heavy.3.raw
cgatcgtatacacgaccggtgctcgatttagctagtcactcaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 448775 - DNA, 512 bp, Homo sapiens; identical to SEQ ID NO: 445688
  misc_feature: HEFZJCU01B20QN.3.34.D01.1.454.heavy.3.raw

SEQ ID NO: 448776 - DNA, 428 bp, Homo sapiens
  misc_feature: HEFZJCU01DU9SF.51.77.G11.1.454.heavy.3.raw
cgatcgtatacacgaccggtgctcgatttagctagtcactcaagggaaagggaaggggaaagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 448777 - DNA, 530 bp, Homo sapiens
  misc_feature: HEFZJCU01CV5VZ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaaccctggtcaccgtctccccaccctccaccg

SEQ ID NO: 448778 - DNA, 499 bp, Homo sapiens
  misc_feature: HEFZJCU01D2PP0.10.28.C06.1.454.heavy.3.raw
catagtagtgcacgaccggtgctcgatttagagctcacgtattgggtttggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaaatagggtctacgattactcattctgactactggggccagggaaccctggtcaccgtctcctcagcctccaccaagggcccatcggtcttcccctggcgccctgctccaggagcacctccgagagcacagcggccctgggctgcctggtcaaggactactcccactactatg

SEQ ID NO: 448779 - DNA, 494 bp, Homo sapiens
  misc_feature: HEFZJCU01EYYH6.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatgcttttgatatgtggg

SEQ ID NO: 448780 - DNA, 372 bp, Homo sapiens
  misc_feature: HEFZJCU01DOIIX.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaactcactgtatctgcaaatgaacagcctgagagtcgaggacagtggtgtatattactgtgcgagccccggcgcttttgggcggaattcgggactgtggggccagggaaccctggtcagcgtctcagcctccaccaagggcccatcggtcttccccctggcgccctgctccaggagcacctccgagagcacagcggccctgggctgcctggtaaggactactcctagagacacg

SEQ ID NO: 448781 - DNA, 486 bp, Homo sapiens; identical to SEQ ID NO: 444861
  misc_feature: HEFZJCU01DTWST.47.55.E11.1.454.heavy.3.raw

SEQ ID NO: 448782 - DNA, 498 bp, Homo sapiens; identical to SEQ ID NO: 445952
  misc_feature: HEFZJCU01CM3L5.11.71.G05.1.454.heavy.3.raw

SEQ ID NO: 448783 - DNA, 503 bp, Homo sapiens; identical to SEQ ID NO: 445995
  misc_feature: HEFZJCU01BYJXA.17.25.C03.1.454.heavy.3.raw

SEQ ID NO: 448784 - DNA, 519 bp, Homo sapiens
  misc_feature: HEFZJCU01E0ACD.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaacccgtggtcaccgtctcttcagcctccaccaaggcccatcggtcttcccctcggcaccctcctccaagagcacctctgggggcacagcc

SEQ ID NO: 448785 - DNA, 510 bp, Homo sapiens
  misc_feature: HEFZJCU01CAQCR.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccggatattgttatagaaccacctgctatctgagctggttcgactgctggggccagggaaccctggtcaccg

SEQ ID NO: 448786 - DNA, 526 bp, Homo sapiens
  misc_feature: HEFZJCU01EAME5.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtcgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcaccccgtgggccagggaaccctggtcaccgtctcctcagcctccaccg

SEQ ID NO: 448787 - DNA, 506 bp, Homo sapiens; identical to SEQ ID NO: 446520
  misc_feature: HEFZJCU01D58MN.10.38.D05.1.454.heavy.3.raw

SEQ ID NO: 448788 - DNA, 507 bp, Homo sapiens
  misc_feature: HEFZJCU01DUQBZ.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaaggcccatcggtcttcccctggcgccctgctccaggagcacctccgagagcacagcggccctgggctgcctggtcaaggactacttctagacgtatca

SEQ ID NO: 448789 - DNA, 316 bp, Homo sapiens; identical to SEQ ID NO: 444479
  misc_feature: HEFZJCU01BLCK6.47.84.H07.1.454.heavy.3.raw

SEQ ID NO: 448790 - DNA, 395 bp, Homo sapiens; identical to SEQ ID NO: 447229
  misc_feature: HEFZJCU01CJM0D.47.59.F04.1.454.heavy.3.raw

SEQ ID NO: 448791 - DNA, 509 bp, Homo sapiens
  misc_feature: HEFZJCU01EJO9I.16.21.B10.1.454.heavy.3.raw
  modified_base (497)..(497): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaaggccggttcaccatctccagagacaattccaagaacacactgtatctgcaaatgaacagcctgagagccgacgacacggccatatattactgtgcgaaagcaccggcagttgtcacccatactactttnactactgggccg

SEQ ID NO: 448792 - DNA, 508 bp, Homo sapiens
  misc_feature: HEFZJCU01ALWD5.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgacgagccgaggacacggccacatattactgtgcgaaagatctcgggctggttccgcggtccgggt

SEQ ID NO: 448793 - DNA, 499 bp, Homo sapiens; identical to SEQ ID NO: 447220
  misc_feature: HEFZJCU01CFVAI.12.14.B03.1.454.heavy.3.raw

SEQ ID NO: 448794 - DNA, 505 bp, Homo sapiens
  misc_feature: HEFZJCU01DCT9D.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctgcgccctgctccaggagcacctccgagagcacagcggccctc

SEQ ID NO: 448795 - DNA, 403 bp, Homo sapiens; identical to SEQ ID NO: 444540
  misc_feature: HEFZJCU01BWE8A.16.72.G06.1.454.heavy.3.raw

SEQ ID NO: 448796 - DNA, 509 bp, Homo sapiens; identical to SEQ ID NO: 444586
  misc_feature: HEFZJCU01AZRPM.12.78.H01.1.454.heavy.3.raw

SEQ ID NO: 448797 - DNA, 349 bp, Homo sapiens
  misc_feature: HEFZJCU01CQDEZ.8.12.B01.1.454.heavy.3.raw
ctcgcgtgtccacgaccggtgctcgatttagtagtgtagatttgggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 448798 - DNA, 502 bp, Homo sapiens
  misc_feature: HEFZJCU01D4BKZ.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggcc

SEQ ID NO: 448799 - DNA, 486 bp, Homo sapiens; identical to SEQ ID NO: 444861
  misc_feature: HEFZJCU01DERSQ.47.55.E11.1.454.heavy.3.raw

SEQ ID NO: 448800 - DNA, 506 bp, Homo sapiens; identical to SEQ ID NO: 444696
  misc_feature: HEFZJCU01ARVFD.16.34.D01.1.454.heavy.3.raw

SEQ ID NO: 448801 - DNA, 396 bp, Homo sapiens
  misc_feature: HEFZJCU01CAQIL.51.68.G02.1.454.heavy.3.raw
cgatcgtatacacgaccggtgctcgatttagtcgatagtgaagggaaaggggctggagtggatcggagaaatccaccatagtggaaacaccaactacagcccgtccctcaagagtcgaatcaccttatcagtagacacggccaagaaccagttctccctgaggctgacttctgttaccgccgcggacacggctgtttattactgtgcgagagctttgccaagttcgtctcgttttgacccatactttgactcctggggccaaggaacgctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 448802 - DNA, 507 bp, Homo sapiens
  misc_feature: HEFZJCU01BK9Z0.52.67.G01.1.454.heavy.3.raw
cgcagtacgacacgaccggtgctcgatttagagtatacatattgggtttgggagatcatgagggtgtccctgagactctcctgtgcagcctctggattcagctttgatgagtatgccatgcactgggtccggcaggctccagggaagggcctggagtgggtctcaggtattagttggactagtggtagtataggctatggggcctctgtgaagggccgattcaccatctccagagacaacgccaagaactccctgtctctgcaaatgaacggactgagagttgaggacacgggcttctactattgtgcaaaaggccctgcccttttctatgatatcactgcttattactacacgccggttgactcctggggccagggaaccctggtcaccgtctcctcagcctccaccaagggcccatcggtcttcccctggcaccctcctccaagagcacctctgggggcacagcggccctgggctgcctggtcaaggactactcctatacgatcg

SEQ ID NO: 448803 - DNA, 492 bp, Homo sapiens
  misc_feature: HEFZJCU01DGYUH.48.20.B09.1.454.heavy.3.raw
agtatacatacacgaccggtgctcgatttagtgtagtgtgaaggggggggccgtggtaccgcctggggggtcccgttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 448804 - DNA, 521 bp, Homo sapiens
  misc_feature: HEFZJCU01EH7GL.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttcccctggccg

SEQ ID NO: 448805 - DNA, 526 bp, Homo sapiens
  misc_feature: HEFZJCU01C9BXJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtcttcccctggcgcctcg

SEQ ID NO: 448806 - DNA, 400 bp, Homo sapiens; identical to SEQ ID NO: 444452
  misc_feature: HEFZJCU01ATV8N.47.24.C02.1.454.heavy.3.raw

SEQ ID NO: 448807 - DNA, 506 bp, Homo sapiens
  misc_feature: HEFZJCU01ARR4Q.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcgccctgctccaggagcacctccgagag

SEQ ID NO: 448808 - DNA, 410 bp, Homo sapiens; identical to SEQ ID NO: 444689
  misc_feature: HEFZJCU01CKUHS.52.87.H10.1.454.heavy.3.raw

SEQ ID NO: 448809 - DNA, 385 bp, Homo sapiens; identical to SEQ ID NO: 446553
  misc_feature: HEFZJCU01DIUVS.18.60.F05.1.454.heavy.3.raw

SEQ ID NO: 448810 - DNA, 513 bp, Homo sapiens
  misc_feature: HEFZJCU01B3P3L.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatgggggcccacgaacgttactacgctatggacgtctggggccg

SEQ ID NO: 448811 - DNA, 509 bp, Homo sapiens
  misc_feature: HEFZJCU01BGJB8.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagagggggtttgacgtggaactccttctacatggacgtcgtggggcaaagggaccg

SEQ ID NO: 448812 - DNA, 470 bp, Homo sapiens; identical to SEQ ID NO: 444866
  misc_feature: HEFZJCU01ATSL1.4.36.D03.1.454.heavy.3.raw

SEQ ID NO: 448813 - DNA, 521 bp, Homo sapiens
  misc_feature: HEFZJCU01A40K3.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagcgtggtttccgtgtaggtagttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccccgtggggccaggggaaccctgggtccaccgtctcctca

SEQ ID NO: 448814 - DNA, 386 bp, Homo sapiens; identical to SEQ ID NO: 444972
  misc_feature: HEFZJCU01DUQVE.27.46.E02.1.454.heavy.3.raw

SEQ ID NO: 448815 - DNA, 501 bp, Homo sapiens; identical to SEQ ID NO: 447719
  misc_feature: HEFZJCU01E0I80.17.10.A10.1.454.heavy.3.raw

SEQ ID NO: 448816 - DNA, 314 bp, Homo sapiens; identical to SEQ ID NO: 444774
  misc_feature: HEFZJCU01DEAX9.7.10.A10.1.454.heavy.3.raw

SEQ ID NO: 448817 - DNA, 499 bp, Homo sapiens; identical to SEQ ID NO: 447220
  misc_feature: HEFZJCU01BPKW6.12.14.B03.1.454.heavy.3.raw

SEQ ID NO: 448818 - DNA, 486 bp, Homo sapiens
  misc_feature: HEFZJCU01ENV35.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcaccgtctcttcagcttccaccaagggcccatcggtcttcccctggcgcctgctccaggagcacctctgggggcacagcggccctgggctgcctggtcaaggactacttcctacgtgagct

SEQ ID NO: 448819 - DNA, 392 bp, Homo sapiens; identical to SEQ ID NO: 444682
  misc_feature: HEFZJCU01C7DY4.16.70.G04.1.454.heavy.3.raw

SEQ ID NO: 448820 - DNA, 519 bp, Homo sapiens
  misc_feature: HEFZJCU01DG2SA.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 448821 - DNA, 512 bp, Homo sapiens
  misc_feature: HEFZJCU01CPXUG.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 448822 - DNA, 507 bp, Homo sapiens
  misc_feature: HEFZJCU01CYI0B.48.44.D11.1.454.heavy.3.raw
  modified_base (463)..(463): a, c, t, g, unknown or other
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacngcggccctgggctgcctggtcaaggactacttcctatgtatact

SEQ ID NO: 448823 - DNA, 399 bp, Homo sapiens; identical to SEQ ID NO: 444537
  misc_feature: HEFZJCU01CUFBV.16.29.C07.1.454.heavy.3.raw

SEQ ID NO: 448824 - DNA, 512 bp, Homo sapiens
  misc_feature: HEFZJCU01DUJ4J.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggtattagtcacccatactactttgacttactggggccaac

SEQ ID NO: 448825 - DNA, 391 bp, Homo sapiens
  misc_feature: HEFZJCU01AJ5FW.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtgtattactgtgcgagccacaccgattacgatttttggagtggccttgataactggggccaggggatcctggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 448826 - DNA, 491 bp, Homo sapiens; identical to SEQ ID NO: 446104
  misc_feature: HEFZJCU01BR5YD.3.34.D01.1.454.heavy.3.raw

SEQ ID NO: 448827 - DNA, 497 bp, Homo sapiens
  misc_feature: HEFZJCU01DPRBC.53.62.F07.1.454.heavy.3.raw
cgcgtatacacacgaccggtgctcgatttagtagtcgcataaagggaaaggggaagactgacggtcctcccaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttactatgatgccagtggtttagtaccgttcgacccctgggccagggaaccctggtcaccgtctcctcagcttccaccaaggcccatcggtcttcccctcggcgccctgct

SEQ ID NO: 448828 - DNA, 519 bp, Homo sapiens
  misc_feature: HEFZJCU01CUH07.12.71.G05.1.454.heavy.3.raw
  modified_base (476)..(476): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccagagcacctccgangcacagcggccctgggctgcctggtcaaggactacttcctacg

SEQ ID NO: 448829 - DNA, 511 bp, Homo sapiens
  misc_feature: HEFZJCU01EADMF.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggccaagggacactggtcaccgtctcttcagcctccaccaacgggcccatcgtccttccccctggccgccctcgcctccgaggacg

SEQ ID NO: 448830 - DNA, 398 bp, Homo sapiens
  misc_feature: HEFZJCU01C5UBN.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccgacatattactgtgcgagaggaattttgactggttattcctactactttgactactggggccagggcactccggtcaccgtctcctcagcctccaccaagggcccatcggtcttccccctggcgaccctcctccaagagcacctctgggggcacagcggccctgggctgcctggtcaaggactacttcccatactcgta

SEQ ID NO: 448831 - DNA, 482 bp, Homo sapiens; identical to SEQ ID NO: 444503
  misc_feature: HEFZJCU01BE1TJ.7.10.A10.1.454.heavy.3.raw

SEQ ID NO: 448832 - DNA, 505 bp, Homo sapiens
  misc_feature: HEFZJCU01EG2VZ.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgctggtcaaggactacttcctatgtatact

SEQ ID NO: 448833 - DNA, 405 bp, Homo sapiens
  misc_feature: HEFZJCU01ETLMK.9.31.C09.1.454.heavy.3.raw
tgatacgtctcacgaccggtgctcgatttagacgtctcatcaaggaaggaaggggctggagtgggttggacgtcttaaaagcaagggtagcggtgggacagcagactacgcttcatccgtgaagggcagattcagcatttccagagacgatgcaagacagatgatgtatttacagatgaacagcctaaaaatcggagacacagccctatatttctgcgtcttcatttcgcagtgggagctccggtttacggtcggtgacttctggggccggggagccatggtcaccgtctcctcagcctccaccaagggcccatcggtcttccccctggcgccctgctccaggagcacctccgagagcacagcggccctgggctgcctggtcaaggactacttccagacgtatca

SEQ ID NO: 448834 - DNA, 489 bp, Homo sapiens
  misc_feature: HEFZJCU01DLIKF.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctgcgccctgctccaggagcacctccgagagcacagcggccctgggctgcctggtcaagactacttccgtatctctcg

SEQ ID NO: 448835 - DNA, 489 bp, Homo sapiens
  misc_feature: HEFZJCU01EHXWS.47.85.H08.1.454.heavy.3.raw
agctcacgtacacgaccggtgctcgatttagtatcactcagtcgggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctggcgccctgctccaggagcacctccgagagcacagcggccctgggctgcctggtcaaggactacttcctacgtgagct

SEQ ID NO: 448836 - DNA, 508 bp, Homo sapiens
  misc_feature: HEFZJCU01CLLTP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccgggcagttagtcacccatactactttgactactgggg

SEQ ID NO: 448837 - DNA, 396 bp, Homo sapiens; identical to SEQ ID NO: 444568
  misc_feature: HEFZJCU01BSGUM.47.46.E02.1.454.heavy.3.raw

SEQ ID NO: 448838 - DNA, 515 bp, Homo sapiens
  misc_feature: HEFZJCU01CFALX.49.26.C04.1.454.heavy.3.raw
agtcgagagacacgaccggtgctcgatttagtctagcgactttggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctaaggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttcgacctac

SEQ ID NO: 448839 - DNA, 522 bp, Homo sapiens
  misc_feature: HEFZJCU01C7T56.52.75.G09.1.454.heavy.3.raw
  modified_base (519)..(519): a, c, t, g, unknown or other
cgcagtacgacacgaccggtgctcgatttagtatagacatcagggggagagaggagcccagccctgggattttcaggtgttttcatttggtgatcaggactgaacagagagaactcaccatggagtttgggctgagctggctttttcttgtggctattttaaaaggtgtccatggtgaggtgcggctgttggaatccggggggggcttgatacagcctggggggtccctgagactctcctgtgctgcctctggattcagtttcagtgacttagccatgagctgggtccgccaggctccagggaaggggctggaatgggtctcagtcgttactgctggacttactaccacatactacgcagactccgtgaagggccggttcgccatctccagagacaattccaagaataccctatatctgcaaatgagcagcctgagagccgaggacacggccgtatattactgtgcgatgggaagtagtggttactactactactttgacaactgggccagggaacccnggt

SEQ ID NO: 448840 - DNA, 390 bp, Homo sapiens
  misc_feature: HEFZJCU01BJ5M8.40.66.F11.1.454.heavy.3.raw
tctagcgactcacgaccggtgctcgatttagtcacgcgagaagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 448841 - DNA, 516 bp, Homo sapiens
  misc_feature: HEFZJCU01BEUX4.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcggacacggctgtgtattactgtgcgagaggcttggtagcagtggctcccgggggcttttgactactggggccagggaaccctggtcaccgtctcctcagcctccaccaagggccc

SEQ ID NO: 448842 - DNA, 476 bp, Homo sapiens
  misc_feature: HEFZJCU01B945F.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 448843 - DNA, 384 bp, Homo sapiens
  misc_feature: HEFZJCU01C0X6L.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgaagagcagtggctgggacatggacgtctggggccaagggaccacggtcaccgtctcctcagcctccaccaagggcccatcggtcttccccctggcaccctcctccaagagcacctctgggggcacagcggccctgggctgcctggtcaaggactacttcccatactcgta

SEQ ID NO: 448844 - DNA, 534 bp, Homo sapiens
  misc_feature: HEFZJCU01ERXEE.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaacgggcccatcggtcttcccctggcaccctcctcccaagagcacctctgggggcacagcggccctgggctgcctc

SEQ ID NO: 448845 - DNA, 524 bp, Homo sapiens
  misc_feature: HEFZJCU01CVMBZ.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccgggagccccggtcatcgtct

SEQ ID NO: 448846 - DNA, 499 bp, Homo sapiens
  misc_feature: HEFZJCU01CV5NT.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgccctgctccagagcacctccgagagcacagcggccctgggctgcctggtcaaggactacttcctatgtatact

SEQ ID NO: 448847 - DNA, 519 bp, Homo sapiens; identical to SEQ ID NO: 445617
  misc_feature: HEFZJCU01BNQJS.9.34.D01.1.454.heavy.3.raw

SEQ ID NO: 448848 - DNA, 528 bp, Homo sapiens
  misc_feature: HEFZJCU01ALCLB.49.25.C03.1.454.heavy.3.raw
agtcgagagacacgaccggtgctcgatttagtagtgtagatttgggtttggggtctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctgggacgaggagcccgtacggcgggtcctaacttt

SEQ ID NO: 448849 - DNA, 466 bp, Homo sapiens; identical to SEQ ID NO: 445374
  misc_feature: HEFZJCU01B8GV9.16.78.H01.1.454.heavy.3.raw

SEQ ID NO: 448850 - DNA, 482 bp, Homo sapiens; identical to SEQ ID NO: 444904
  misc_feature: HEFZJCU01EEX6M.47.59.F04.1.454.heavy.3.raw

SEQ ID NO: 448851 - DNA, 463 bp, Homo sapiens; identical to SEQ ID NO: 446208
  misc_feature: HEFZJCU01BPHC9.19.10.A10.1.454.heavy.3.raw

SEQ ID NO: 448852 - DNA, 518 bp, Homo sapiens
  misc_feature: HEFZJCU01EQJBC.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcacagcggccctgggctgcctggtcaaggactacttccgagtagtacac

SEQ ID NO: 448853 - DNA, 500 bp, Homo sapiens
  misc_feature: HEFZJCU01EKG5Z.53.16.B05.1.454.heavy.3.raw
cgcgtatacacacgaccggtgctcgatttagagctcacgtaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggttcagctggtgcagtctgggggaggcgtagtccagcctgggaggtccctgagactctcctgtgtagcctctggattcacccccagaaactctgccatgcactgggtccggcaggctccaggcaaggggctggagtgggtgtccagtatatcgtatgatggtgacagtgaatactacgcagcctccgtgaggggccgattcaccgtctccagagacaattccaagaacacggtgtatctgcaaatgaagggcctgagacctgaggacacggcaacatactactgtgcgaatgacgtggatgtcgtggctacgccttta

SEQ ID NO: 448854 - DNA, 384 bp, Homo sapiens
  misc_feature: HEFZJCU01BCH1K.13.46.E02.1.454.heavy.3.raw
tcacgtactacacgaccggtgctcgatttagactcatctacagggaaagggcctggagtgggtctcaggtatttatgggaacagtgaaagaatagggtatgcggactctgtgaagggccgattcaccatctccagagacaacgccaagaactccctctttttgcaaatgaacagtctgaaaactgaggactcggccttatattactgtctcaaagaaagtaataatgggggtctcgactactggggccagggagccctggtcaccgtctcctcagcctccaccaagggcccatcggtcttccccctggcgccctgctccaggagcacctccgagagcacagcggccctgggctgcctggtcaaggactacttcctagtacgtga

SEQ ID NO: 448855 - DNA, 339 bp, Homo sapiens; identical to SEQ ID NO: 444436
  misc_feature: HEFZJCU01D1YCF.47.38.D05.1.454.heavy.3.raw

SEQ ID NO: 448856 - DNA, 500 bp, Homo sapiens; identical to SEQ ID NO: 444529
  misc_feature: HEFZJCU01EYOFT.12.38.D05.1.454.heavy.3.raw

SEQ ID NO: 448857 - DNA, 526 bp, Homo sapiens
  misc_feature: HEFZJCU01CB2KZ.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggccagggaaccctggtcaccgtctcctcagcctccaccg

SEQ ID NO: 448858 - DNA, 467 bp, Homo sapiens; identical to SEQ ID NO: 445004
  misc_feature: HEFZJCU01EP82F.16.78.H01.1.454.heavy.3.raw

SEQ ID NO: 448859 - DNA, 523 bp, Homo sapiens
  misc_feature: HEFZJCU01CRN7M.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggataccttcagcactggggccagggcaccctggtcaccgtctcctcagcctccaccaagggcccatcggtcttcccctggcacctcctccaagagcacctctcgggggcacgagcc

SEQ ID NO: 448860 - DNA, 516 bp, Homo sapiens
  misc_feature: HEFZJCU01EDBCO.48.34.D01.1.454.heavy.3.raw
agtatacatacacgaccggtgctcgatttagatcgtctgtgttgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactacttcctatgta

SEQ ID NO: 448861 - DNA, 538 bp, Homo sapiens
  misc_feature: HEFZJCU01CVI6T.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttcccctggcaccctcctccaagagcacctctgggggcacagcc

SEQ ID NO: 448862 - DNA, 486 bp, Homo sapiens
  misc_feature: HEFZJCU01D1IAV.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctggctgcctggtcaaggactacttcctacgtgagct

SEQ ID NO: 448863 - DNA, 500 bp, Homo sapiens; identical to SEQ ID NO: 445080
  misc_feature: HEFZJCU01A7K0F.3.81.H04.1.454.heavy.3.raw

SEQ ID NO: 448864 - DNA, 503 bp, Homo sapiens
  misc_feature: HEFZJCU01BRMQ5.48.33.C11.1.454.heavy.3.raw
agtatacatacacgaccggtgctcgatttagagtgagctcgttgggtttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgtctcttcagcctccaccaa

SEQ ID NO: 448865 - DNA, 510 bp, Homo sapiens
  misc_feature: HEFZJCU01C5CVY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgacgccctacggcaggcggccttttgacctttcgt

SEQ ID NO: 448866 - DNA, 502 bp, Homo sapiens; identical to SEQ ID NO: 445563
  misc_feature: HEFZJCU01CSWQA.10.38.D05.1.454.heavy.3.raw

SEQ ID NO: 448867 - DNA, 490 bp, Homo sapiens
  misc_feature: HEFZJCU01B8GFW.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggccatcggtcttcccctggcaccctcctccaagagcacctctgggggcacagcggccctgggctgcctggtcaaggactacttccgtatctctcg

SEQ ID NO: 448868 - DNA, 385 bp, Homo sapiens; identical to SEQ ID NO: 444438
  misc_feature: HEFZJCU01CID5K.18.60.F05.1.454.heavy.3.raw

SEQ ID NO: 448869 - DNA, 515 bp, Homo sapiens
  misc_feature: HEFZJCU01BQ8CD.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacgtctggacgtctgtggccagggaccg

SEQ ID NO: 448870 - DNA, 378 bp, Homo sapiens
  misc_feature: HEFZJCU01BTR7A.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcaaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 448871 - DNA, 511 bp, Homo sapiens
  misc_feature: HEFZJCU01C4EZ8.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccagggcccatcggtcttcccctggcaccctcctccaagagcacctctgggggcacagcggccctgggctgcctggtcaaggactacttccgagtgcgtct

SEQ ID NO: 448872 - DNA, 495 bp, Homo sapiens; identical to SEQ ID NO: 444618
  misc_feature: HEFZJCU01CUB4R.3.26.C04.1.454.heavy.3.raw

SEQ ID NO: 448873 - DNA, 495 bp, Homo sapiens; identical to SEQ ID NO: 448736
  misc_feature: HEFZJCU01A1U6T.16.37.D04.1.454.heavy.3.raw

SEQ ID NO: 448874 - DNA, 507 bp, Homo sapiens
  misc_feature: HEFZJCU01EN9OB.40.39.D06.1.454.heavy.3.raw
tctagcgactcacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgattgccttttgatatgttggggccaaggggacaagtggtccg

SEQ ID NO: 448875 - DNA, 505 bp, Homo sapiens
  misc_feature: HEFZJCU01ADZRX.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttatactgtgcgagagggaagtgggatattgtggcagctccaggtgcccagccgggccctactttgactactc

SEQ ID NO: 448876 - DNA, 523 bp, Homo sapiens
  misc_feature: HEFZJCU01C5JTO.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattacgtccctactttgactacgtggggccagggaactcgtggtcaccgtctccgcacgcctccaccaacgggcccatccgg

SEQ ID NO: 448877 - DNA, 506 bp, Homo sapiens
  misc_feature: HEFZJCU01CXVGB.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttccgtactagacg

SEQ ID NO: 448878 - DNA, 437 bp, Homo sapiens
  misc_feature: HEFZJCU01BZHDB.53.40.D07.1.454.heavy.3.raw
cgcgtatacacacgaccggtgctcgatttagtgatagagcgtaacaacagagggtctgctgggcctcccatggggtgtcctgtcacaggtacagctgcagcagtcaggtccaggactggtgaagccctcgcagaccctctcactcacctgtggcatctccggggacagtgtctctagcaacagcgctgcttggaattggatcaggcagtccccttcgagaggccttgagtggctgggaaggacatactacaggtccaagtggtataatgattatgctgtatctgtaaaaagtcgaataagcatcaacccagacacatccaagaaccagttctcccttcagctgaactctgtgactcccgaggacacggctgtctattactgtgcaagtgagtcccgctatagcagtgcctggtcaaggactacttcctcgtactgcg

SEQ ID NO: 448879 - DNA, 499 bp, Homo sapiens
  misc_feature: HEFZJCU01C2GQL.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgcctgctccaggagcacctccgagagcacagcggccctgggctgcctggtcaaggactacttccga

SEQ ID NO: 448880 - DNA, 533 bp, Homo sapiens
  misc_feature: HEFZJCU01ERUN2.16.87.H10.1.454.heavy.3.raw
tgtactactccacgaccggtgctcgatttagcagtactgcgttgggtttgggggcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagttgggtttttttttcgttacgttacgggat

SEQ ID NO: 448881 - DNA, 567 bp, Homo sapiens
  misc_feature: HEFZJCU01D3CRE.48.12.B01.1.454.heavy.3.raw
agtatacatacacgaccggtgctcgatttagtagtgtagattccgcgggcacgaccggtgctcgatttagctcgatatagttgggtttggggacttttccaatttttttggggccagcgctgggtctcttgccaagagaaccccggagtagttgggggggctcaggaacctgccctaagacaacagcgtccacacagacgaggggctacgggtcctcacagacgaagggcacggggtccagatgatccctcctcctggccccgccacctcgtctctttctgcggccaggcgcactctgggcctctggggtcaagtggccggcaacccccgggccctccccggcctctgtctcagagagtcccagggacgtggcggggcgccggttcttccctggggtcctggcgttgttgtcaccttgtgtcacctgtttcgacccctgggcccagggagccctggtcaccgtctccttagcctccaccaaggcccatcggtcttcccctggcgcctgctccagagcacctccgagagcacagcggccctgggctgcctggtcaaggactactccta

SEQ ID NO: 448882 - DNA, 499 bp, Homo sapiens
  misc_feature: HEFZJCU01DE3PG.40.59.F04.1.454.heavy.3.raw
tctagcgactcacgaccggtgctcgatttagtacacacacttagggattggggctgggagtggagccccagccttgggattcccaagtatttgtattcagtgatcaggactgaacacacaggactcaccatggagttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaggggggagcagctcgtccatccta

SEQ ID NO: 448883 - DNA, 396 bp, Homo sapiens
  misc_feature: HEFZJCU01BTY87.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacccccgagagcacagcggccctgggctgcctggtcaaggactacttcctacgtgagct

SEQ ID NO: 448884 - DNA, 542 bp, Homo sapiens
  misc_feature: HEFZJCU01DY53C.4.71.G05.1.454.heavy.3.raw
agcactgtagcacgaccggtgctcgatttagtgtcgtcgcaagagagagggggaagaccgatgggcccttgtggaggcttggtgaagccggggggtcccgttacgactctcctgtgcagtctctggactcaacctacaaaatagcctggatgacctgggtccgccagactccagggaaggggcgtgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctcccaggagcacctcccgagagcacagccggccctgggctgccctgggtcaagggactactttccctac

SEQ ID NO: 448885 - DNA, 530 bp, Homo sapiens
  misc_feature: HEFZJCU01CEUXI.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgagaaccccacctatgcccaggcccttcacagggcggtttgtcttctccatggatacctctgtcgggacggcttatctgcagataaccaaccttcaacctgacgacactgccgtttatttttgtacgagagcgtcgtctgtcagtggattgactactggggccagggaaccctggtcaccgtctcctcagcctccaccaac

SEQ ID NO: 448886 - DNA, 506 bp, Homo sapiens; identical to SEQ ID NO: 444696
  misc_feature: HEFZJCU01DUZXR.16.34.D01.1.454.heavy.3.raw

SEQ ID NO: 448887 - DNA, 488 bp, Homo sapiens
  misc_feature: HEFZJCU01EX9V3.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacatggccgtctatttttgtgcgacagaaagagattccatactcaggcggggcactatggcagcag

SEQ ID NO: 448888 - DNA, 507 bp, Homo sapiens
  misc_feature: HEFZJCU01C2UI1.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggcctggctgcctggtcaggactactccatacc

SEQ ID NO: 448889 - DNA, 524 bp, Homo sapiens
  misc_feature: HEFZJCU01CUR33.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagcgtggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccacctccaccg

SEQ ID NO: 448890 - DNA, 482 bp, Homo sapiens; identical to SEQ ID NO: 444503
  misc_feature: HEFZJCU01ESQ6Y.7.10.A10.1.454.heavy.3.raw

SEQ ID NO: 448891 - DNA, 518 bp, Homo sapiens; identical to SEQ ID NO: 444718
  misc_feature: HEFZJCU01DT0L0.9.34.D01.1.454.heavy.3.raw

SEQ ID NO: 448892 - DNA, 408 bp, Homo sapiens
  misc_feature: HEFZJCU01CYYIK.3.17.B06.1.454.heavy.3.raw
agacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtgggtctactggggccagggaaccctggtcaccgtctcctcagcctccaccaagggcccatcggtcttccccctggcgccctgctccaggtttagcacctccgagagcacagcggccctgggctgcctggtcaaggactacttccgagtgcgtct

SEQ ID NO: 448893 - DNA, 509 bp, Homo sapiens
  misc_feature: HEFZJCU01CH6M3.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctgcgccctgctccagagcacctctgggggcacagcggccctgggctgcctggtcaaggactacttcccata

SEQ ID NO: 448894 - DNA, 493 bp, Homo sapiens
  misc_feature: HEFZJCU01EBRLC.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctggtttcctcgttgctctttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcac

SEQ ID NO: 448895 - DNA, 499 bp, Homo sapiens
  misc_feature: HEFZJCU01BNWC1.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccctggcgccctgctccaggagcacctcgtgggggcacagcggccctgggctgcctggtcaaggactacttcctacgtcgtat

SEQ ID NO: 448896 - DNA, 503 bp, Homo sapiens; identical to SEQ ID NO: 445995
  misc_feature: HEFZJCU01CYMHU.17.25.C03.1.454.heavy.3.raw

SEQ ID NO: 448897 - DNA, 506 bp, Homo sapiens; identical to SEQ ID NO: 444696
  misc_feature: HEFZJCU01ARIYO.16.34.D01.1.454.heavy.3.raw

SEQ ID NO: 448898 - DNA, 507 bp, Homo sapiens
  misc_feature: HEFZJCU01DVL6E.51.40.D07.1.454.heavy.3.raw
cgatcgtatacacgaccggtgctcgatttagtgatagagcgtaacaacagagggggctctgggagaggagcccagcactagaagtcggcggtgtttccattcggtgatcaacactgaacacagaggactcaccatggagtttgggctgagcgtggtttccgtcgttaggctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttaatcacggaggacaaaccc

SEQ ID NO: 448899 - DNA, 483 bp, Homo sapiens; identical to SEQ ID NO: 444639
  misc_feature: HEFZJCU01AH1KB.11.23.C01.1.454.heavy.3.raw

SEQ ID NO: 448900 - DNA, 317 bp, Homo sapiens
  misc_feature: HEFZJCU01DUCD3.13.17.B06.1.454.heavy.3.raw
tcacgtactacacgaccggtgctcgatttagtcgatagtgaagggccgattcaccgatctccagagacaacgccaagaactcactgtatctgcagatgaccagcctgagagtcgaggatacggctgtgtattattgtgcgagagatggggcacgacattttgtagaggtgtactgggccagggagccccggtcaccgtccctcctcagcctccaccaagggcccatcggtcttccccctggcgccctgctccaggagcacctccgagagcacagcggccctgggctgcctggtcaaggactacttcctagtacgtga

SEQ ID NO: 448901 - DNA, 522 bp, Homo sapiens
  misc_feature: HEFZJCU01A40HY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgcctggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 448902 - DNA, 400 bp, Homo sapiens; identical to SEQ ID NO: 447616
  misc_feature: HEFZJCU01EJV57.4.77.G11.1.454.heavy.3.raw

SEQ ID NO: 448903 - DNA, 515 bp, Homo sapiens
  misc_feature: HEFZJCU01DE6R2.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctggagcgtggacgtttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatataattactgtgcgaaagcaccggcagttagtcacccatactactttgactactggggccg

SEQ ID NO: 448904 - DNA, 378 bp, Homo sapiens
  misc_feature: HEFZJCU01BIC69.4.29.C07.1.454.heavy.3.raw
agcactgtagcacgaccggtgctcgatttagagtgctacgaagggaaaggggctggagtgggttggccatattaaaagcaaatctgatggtgggacaatacactacgctgcacccgtgaaaggcagattcaccatctcaagagacacttcaagaaattcattgtatctgcaaatgaacagtttgaaaaccgaggacacagccgtgtattattgtacagctggacactattctccctggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 448905 - DNA, 396 bp, Homo sapiens; identical to SEQ ID NO: 446990
  misc_feature: HEFZJCU01EHUD6.51.70.G04.1.454.heavy.3.raw

SEQ ID NO: 448906 - DNA, 498 bp, Homo sapiens
  misc_feature: HEFZJCU01A56HC.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtct

SEQ ID NO: 448907 - DNA, 510 bp, Homo sapiens
  misc_feature: HEFZJCU01ETOZ4.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctgggg

SEQ ID NO: 448908 - DNA, 476 bp, Homo sapiens; identical to SEQ ID NO: 444605
  misc_feature: HEFZJCU01CRF9S.12.81.H04.1.454.heavy.3.raw

SEQ ID NO: 448909 - DNA, 491 bp, Homo sapiens; identical to SEQ ID NO: 447491
  misc_feature: HEFZJCU01BEFI4.4.57.F02.1.454.heavy.3.raw

SEQ ID NO: 448910 - DNA, 510 bp, Homo sapiens
  misc_feature: HEFZJCU01BZK7B.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggcaccctcctccaagagcacctctgggggcacagcggccctgggctgcctggtcaaggactacttccgtact

SEQ ID NO: 448911 - DNA, 508 bp, Homo sapiens
  misc_feature: HEFZJCU01BZ4D0.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctcgagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccagagcacctctgggggcacagcggccctgggctgcctggtcaaggactacttcctacgtcgtat

SEQ ID NO: 448912 - DNA, 408 bp, Homo sapiens
  misc_feature: HEFZJCU01A5Q24.49.73.G07.1.454.heavy.3.raw
agtcgagagacacgaccggtgctcgatttagctctacgctcagggcacgaccggtgctcgatttagtacagatcgttagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 448913 - DNA, 375 bp, Homo sapiens; identical to SEQ ID NO: 445125
  misc_feature: HEFZJCU01DNSB0.9.53.E09.1.454.heavy.3.raw

SEQ ID NO: 448914 - DNA, 516 bp, Homo sapiens
  misc_feature: HEFZJCU01EQB13.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatcctccagagacgattccgaaaacacagtgaatctgcaaatgtacagcctcagcgccgaggacacggccgtctacttctgtgcgaaagacctctattttgggccgcggccgactacgtggggccgac

SEQ ID NO: 448915 - DNA, 490 bp, Homo sapiens
  misc_feature: HEFZJCU01DEHVN.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggccatcggtcttcccctggcgccctgctccaggagcacctccgagagcacagcggcccgtgggctcgcctggtcaaggactacttcctacgtgagct

SEQ ID NO: 448916 - DNA, 505 bp, Homo sapiens
  misc_feature: HEFZJCU01AODGX.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagcgtggtttcgtgtaggctattctaaaaggtgtccactgtgaggttcaactggtggagactggaggaggctggatccagcctggggggtccctgagactctcctgtgcagcctctgggttcagcatcagtaacgactacatgaccttgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 448917 - DNA, 519 bp, Homo sapiens; identical to SEQ ID NO: 445330
  misc_feature: HEFZJCU01EYIC6.7.78.H01.1.454.heavy.3.raw

SEQ ID NO: 448918 - DNA, 521 bp, Homo sapiens
  misc_feature: HEFZJCU01EVMO9.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggccatcggtctcccctggcgcctgctccaggagcacctccgag

SEQ ID NO: 448919 - DNA, 514 bp, Homo sapiens
  misc_feature: HEFZJCU01EXURM.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctgggccagggaaccctggtcaccgtctcctcagcctccaccaagggcccatcggtcttcccctggcaccctcctccaagagcacctctgggggcacagcggccctgggctgcctggctaggaacgtacttccgtacgtacg

SEQ ID NO: 448920 - DNA, 424 bp, Homo sapiens
  misc_feature: HEFZJCU01BJLZP.51.62.F07.1.454.heavy.3.raw
cgatcgtatacacgaccggtgctcgatttagtagtcgcataaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtgggacacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 448921 - DNA, 403 bp, Homo sapiens; identical to SEQ ID NO: 444658
  misc_feature: HEFZJCU01DCD8G.14.60.F05.1.454.heavy.3.raw

SEQ ID NO: 448922 - DNA, 498 bp, Homo sapiens
  misc_feature: HEFZJCU01EQ70L.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaagcggtggcctatc

SEQ ID NO: 448923 - DNA, 501 bp, Homo sapiens; identical to SEQ ID NO: 445027
  misc_feature: HEFZJCU01A1U3Z.26.23.C01.1.454.heavy.3.raw

SEQ ID NO: 448924 - DNA, 517 bp, Homo sapiens
  misc_feature: HEFZJCU01CXJWH.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctggctgcctggtcaaggactacttcctagagacacg

SEQ ID NO: 448925 - DNA, 491 bp, Homo sapiens
  misc_feature: HEFZJCU01CVS7D.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtggttcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 448926 - DNA, 509 bp, Homo sapiens; identical to SEQ ID NO: 447939
  misc_feature: HEFZJCU01CSF5D.17.25.C03.1.454.heavy.3.raw

SEQ ID NO: 448927 - DNA, 498 bp, Homo sapiens
  misc_feature: HEFZJCU01BVC8B.14.23.C01.1.454.heavy.3.raw
  modified_base (488)..(488): a, c, t, g, unknown or other
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttcgggttctcgtagtgcctggttgagaacgtgggcgaggactctgtcacgtctctcncgcctcaccg

SEQ ID NO: 448928 - DNA, 516 bp, Homo sapiens
  misc_feature: HEFZJCU01ER8XV.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctgggctgcctggtcaaggactactcctagagacacg

SEQ ID NO: 448929 - DNA, 316 bp, Homo sapiens
  misc_feature: HEFZJCU01AY8TN.48.78.H01.1.454.heavy.3.raw
agtatacatacacgaccggtgctcgatttagtgtgagtagtttgggtttggggggaagaggaagactgacggtcctcccaggagttcaggtgctgggcaccttgggcacgggggaggtgtgtcacaagatttgggctctgggcaccgtgggcatggggaggtgtgtcacaagatttgggccagggatacctggtcaccgtctcctcagcttccaccaagggcccatcggtcttccccctggcgccctgctccaggagcacctctggggcacagcggccctgggctgcctggtcaaggactacttcctatgtatact

SEQ ID NO: 448930 - DNA, 505 bp, Homo sapiens
  misc_feature: HEFZJCU01CORV8.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcttcggtccgcgggacttctggggcctaac

SEQ ID NO: 448931 - DNA, 518 bp, Homo sapiens
  misc_feature: HEFZJCU01DKJLL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggacc

SEQ ID NO: 448932 - DNA, 488 bp, Homo sapiens; identical to SEQ ID NO: 445778
  misc_feature: HEFZJCU01D1UGG.18.70.G04.1.454.heavy.3.raw

SEQ ID NO: 448933 - DNA, 535 bp, Homo sapiens
  misc_feature: HEFZJCU01A4XWF.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctctggggaccg

SEQ ID NO: 448934 - DNA, 518 bp, Homo sapiens
  misc_feature: HEFZJCU01ETLZL.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcacctcctccaagagcacctctgggggcacagcggccctgggctgcctggtcaaggactacttcctagagacacg

SEQ ID NO: 448935 - DNA, 477 bp, Homo sapiens; identical to SEQ ID NO: 444659
  misc_feature: HEFZJCU01DWES1.16.10.A10.1.454.heavy.3.raw

SEQ ID NO: 448936 - DNA, 377 bp, Homo sapiens
  misc_feature: HEFZJCU01ECMWW.49.69.G03.1.454.heavy.3.raw
agtcgagagacacgaccggtgctcgatttagtcgctgcgtaaaggagaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 448937 - DNA, 496 bp, Homo sapiens; identical to SEQ ID NO: 446915
  misc_feature: HEFZJCU01CP8WX.3.26.C04.1.454.heavy.3.raw

SEQ ID NO: 448938 - DNA, 554 bp, Homo sapiens
  misc_feature: HEFZJCU01BP7C1.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacgggggggtactactacgctatggacgtctggggccaagggaccacggtcaccgtctcctcagcctccaccaacgggcccatcggtcttccccctggcaccctcctccaacgagcacctctgggggcacg

SEQ ID NO: 448939 - DNA, 496 bp, Homo sapiens
  misc_feature: HEFZJCU01DA4DD.40.34.D01.1.454.heavy.3.raw
tctagcgactcacgaccggtgctcgatttagatcgtctgtgccgaggtgcagctggtgcagtctggagcagaggtgaaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaaggcccatcggtcttccccctggcgccctgctccaggagcacctctgggggcacagcggccctgggctgcctggtcaggactacttccagtcgctaga

SEQ ID NO: 448940 - DNA, 446 bp, Homo sapiens
  misc_feature: HEFZJCU01DEUZP.15.16.B05.1.454.heavy.3.raw
tctacgtagccacgaccggtgctcgatttagagctcacgtattgggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggcgccctgctccaggagcacctccgagagcacagcggccctgggctgcctggtcaggactacttccgctacgtaga

SEQ ID NO: 448941 - DNA, 528 bp, Homo sapiens
  misc_feature: HEFZJCU01AC0VK.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagtttttggctgagcggtggtttcgtcgtaggcgtacttactaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaacgggccattaaccatctccagagacgattccgagaacacggtgtatcttcaaatgaacaacctgagagccgacgacacgggcctttattactgtgcgagagattcgagttggttcggggacctcgaccctggttcctacttcgatcgtctc

SEQ ID NO: 448942 - DNA, 480 bp, Homo sapiens; identical to SEQ ID NO: 445011
  misc_feature: HEFZJCU01DTRKW.22.36.D03.1.454.heavy.3.raw

SEQ ID NO: 448943 - DNA, 506 bp, Homo sapiens
  misc_feature: HEFZJCU01DPN3E.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcaccgtctcttcagcctccaccaagggcccatcggtcttcccctggcgccctgctccaggacg

SEQ ID NO: 448944 - DNA, 487 bp, Homo sapiens
  misc_feature: HEFZJCU01EJQ7Q.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgtatttttgtgcgagagagtctattaaagtggctt

SEQ ID NO: 448945 - DNA, 396 bp, Homo sapiens; identical to SEQ ID NO: 444469
  misc_feature: HEFZJCU01DYA1F.47.46.E02.1.454.heavy.3.raw

SEQ ID NO: 448946 - DNA, 476 bp, Homo sapiens
  misc_feature: HEFZJCU01D14QY.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttcgagtagtaca

SEQ ID NO: 448947 - DNA, 520 bp, Homo sapiens
  misc_feature: HEFZJCU01A4A8V.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtcttcccctggcg

SEQ ID NO: 448948 - DNA, 486 bp, Homo sapiens
  misc_feature: HEFZJCU01B88J5.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctgggaggtccctgagactctcctgtgcagcctctggcttcatcttcagtagctataaaatgcactgggtccaccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccagttgaacatgactatcactactac

SEQ ID NO: 448949 - DNA, 464 bp, Homo sapiens
  misc_feature: HEFZJCU01BZHFP.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgtctggtcaaggactacttccacgagagta

SEQ ID NO: 448950 - DNA, 517 bp, Homo sapiens
  misc_feature: HEFZJCU01AG40N.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacg

SEQ ID NO: 448951 - DNA, 487 bp, Homo sapiens; identical to SEQ ID NO: 445219
  misc_feature: HEFZJCU01AHLRQ.10.85.H08.1.454.heavy.3.raw

SEQ ID NO: 448952 - DNA, 528 bp, Homo sapiens
  misc_feature: HEFZJCU01D0CRP.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactgggggccggggagccccggtcatcgtctcc

SEQ ID NO: 448953 - DNA, 401 bp, Homo sapiens
  misc_feature: HEFZJCU01BUF08.47.24.C02.1.454.heavy.3.raw
agctcacgtacacgaccggtgctcgatttagtacagatcgttagggaaaggggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 448954 - DNA, 495 bp, Homo sapiens; identical to SEQ ID NO: 446642
  misc_feature: HEFZJCU01CMWKI.51.78.H01.1.454.heavy.3.raw

SEQ ID NO: 448955 - DNA, 509 bp, Homo sapiens; identical to SEQ ID NO: 445824
  misc_feature: HEFZJCU01BA2XR.9.14.B03.1.454.heavy.3.raw

SEQ ID NO: 448956 - DNA, 394 bp, Homo sapiens
  misc_feature: HEFZJCU01DXWCR.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactgggccagggatccctggtcgccgtcggctcagcctccaccaagggccatcggtcttccccctggcgccctgctccaggagcacctccgagagcacagcggccctgggctgcctggtcaaggactacttcctacgtgagct

SEQ ID NO: 448957 - DNA, 491 bp, Homo sapiens; identical to SEQ ID NO: 444592
  misc_feature: HEFZJCU01D28QR.11.26.C04.1.454.heavy.3.raw

SEQ ID NO: 448958 - DNA, 521 bp, Homo sapiens
  misc_feature: HEFZJCU01AD9OS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggc

SEQ ID NO: 448959 - DNA, 508 bp, Homo sapiens
  misc_feature: HEFZJCU01D06IG.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttccccctggcaccctcctccaagagcacctctgggggcacagcggccctggctgcctggtcaaggactacttccgagtgcgtct

SEQ ID NO: 448960 - DNA, 464 bp, Homo sapiens; identical to SEQ ID NO: 445533
  misc_feature: HEFZJCU01CM98N.19.10.A10.1.454.heavy.3.raw

SEQ ID NO: 448961 - DNA, 521 bp, Homo sapiens
  misc_feature: HEFZJCU01DLTDS.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttcccctggcgccctgctccacggagcacctccgagagcacagcggccctgggctgcctggtcaaggactacttcctacg

SEQ ID NO: 448962 - DNA, 491 bp, Homo sapiens; identical to SEQ ID NO: 444592
  misc_feature: HEFZJCU01CQBBZ.11.26.C04.1.454.heavy.3.raw

SEQ ID NO: 448963 - DNA, 485 bp, Homo sapiens; identical to SEQ ID NO: 444908
  misc_feature: HEFZJCU01BDWVU.12.40.D07.1.454.heavy.3.raw

SEQ ID NO: 448964 - DNA, 525 bp, Homo sapiens
  misc_feature: HEFZJCU01DJ493.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatccctgaaagcgtcaactactactactacggtatggacctct

SEQ ID NO: 448965 - DNA, 536 bp, Homo sapiens
  misc_feature: HEFZJCU01C9VJ4.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctctggggaccg

SEQ ID NO: 448966 - DNA, 508 bp, Homo sapiens
  misc_feature: HEFZJCU01CVZSZ.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccgggaaccctggtcaccgtctcttcagcctccaccaacgggcccatcggtcttcccctggccaccctcctccaagacgcacctc

SEQ ID NO: 448967 - DNA, 499 bp, Homo sapiens
  misc_feature: HEFZJCU01AHRVK.53.62.F07.1.454.heavy.3.raw
cgcgtatacacacgaccggtgctcgatttagtagtcgcataaagggaaaggggaagactgacggtcctcccaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttactatgatgccagtggtttagtaccgttcgacccctggggccagggaaccctggtcaccgtctcctcagcttccaccaagggcccatcggtcttcccctggccgccctgct

SEQ ID NO: 448968 - DNA, 502 bp, Homo sapiens
  misc_feature: HEFZJCU01C85DJ.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttcgtc

SEQ ID NO: 448969 - DNA, 423 bp, Homo sapiens; identical to SEQ ID NO: 444772
  misc_feature: HEFZJCU01CV75F.16.78.H01.1.454.heavy.3.raw

SEQ ID NO: 448970 - DNA, 382 bp, Homo sapiens
  misc_feature: HEFZJCU01B952S.9.80.H03.1.454.heavy.3.raw
  modified_base (296)..(296): a, c, t, g, unknown or other
tgatacgtctcacgaccggtgctcgatttagctgtgcgtcgaagggaaaggggctggtgtgggtcgcacgtattaatgaagacgggactactataaattacgcggactccgtgaagggccgattcaccatctccagagacgacgccaagaacacgctgtatctgcaaatgaacagtctgagagtcgaggacacggctgtatattactgcgcaaaggattgtttcggggagactgactcctggggccagggaaccctggtcaccgtctcctcagcctccaccaagggcccatcggtnttccccctggcgccctgctccaggagcacctccgagagcacagcggccctgggctgcctggtcaaggactacttccagacgtatca

SEQ ID NO: 448971 - DNA, 505 bp, Homo sapiens; identical to SEQ ID NO: 444759
  misc_feature: HEFZJCU01CKQ8A.10.38.D05.1.454.heavy.3.raw

SEQ ID NO: 448972 - DNA, 506 bp, Homo sapiens; identical to SEQ ID NO: 445864
  misc_feature: HEFZJCU01DTJPX.13.37.D04.1.454.heavy.3.raw

SEQ ID NO: 448973 - DNA, 519 bp, Homo sapiens
  misc_feature: HEFZJCU01C1RJK.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaaggggacc

SEQ ID NO: 448974 - DNA, 490 bp, Homo sapiens; identical to SEQ ID NO: 446494
  misc_feature: HEFZJCU01AFW4L.11.13.B02.1.454.heavy.3.raw

SEQ ID NO: 448975 - DNA, 524 bp, Homo sapiens
  misc_feature: HEFZJCU01CGO8X.48.66.F11.1.454.heavy.3.raw
agtatacatacacgaccggtgctcgatttagtcacgcgagaagggggagccccagccctgggattcccagctgtttctgcttgctgatcaggactgcacacagagaactcaccatggagtttgggctgagctgggttttccttgttgctattttaaaaggtatccagtgtgaggagcagctggtggagtccggcggaggcttagttcagccgggggggtccctgagactctcctgtgtggcctctggattcacaattaatccatattggatcctctgggtccgccaagttccagggaagggctggtttgggtctcacgtatttatgctgctggagatacagcctacgcggactccgtgaagggccgattcaccatctctagagacaacgccaagaacacggtgactctgcaaatggacggtctgagggccgacgacacggctgtctactattgtgacaaaagggccgattaactcttacggtctggacgtctggggccaagggaccacggtcagcgtctctcag

SEQ ID NO: 448976 - DNA, 516 bp, Homo sapiens
  misc_feature: HEFZJCU01B2AJN.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctggctgcctggtcaaggactactcctagagacacg

SEQ ID NO: 448977 - DNA, 533 bp, Homo sapiens
  misc_feature: HEFZJCU01B82R1.51.49.E05.1.454.heavy.3.raw
cgatcgtatacacgaccggtgctcgatttagagcgactagcaacacacaaaggggggttttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagcccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggccc

SEQ ID NO: 448978 - DNA, 511 bp, Homo sapiens
  misc_feature: HEFZJCU01BHN54.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgcccg

SEQ ID NO: 448979 - DNA, 507 bp, Homo sapiens
  misc_feature: HEFZJCU01B38A1.10.88.H11.1.454.heavy.3.raw
catagtagtgcacgaccggtgctcgatttagcgacagcgagaacacacaaacggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacacatgactaccg

SEQ ID NO: 448980 - DNA, 469 bp, Homo sapiens
  misc_feature: HEFZJCU01D9OJN.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttccccctcggcgccctgctccaggagcacctccgagagcacagcggccctgggctgcctggtcaaggactacttccctacagtgct

SEQ ID NO: 448981 - DNA, 489 bp, Homo sapiens; identical to SEQ ID NO: 444791
  misc_feature: HEFZJCU01CW4DM.47.85.H08.1.454.heavy.3.raw

SEQ ID NO: 448982 - DNA, 521 bp, Homo sapiens
  misc_feature: HEFZJCU01DKQ7L.52.74.G08.1.454.heavy.3.raw
  modified_base (488)..(488): a, c, t, g, unknown or other
cgcagtacgacacgaccggtgctcgatttagtagctctatcaggggatgctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagccccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgacacggccctttattactgtgcgcgagtgaacacagcaataacttattatgttgaatattggggccagggaaccccggtnaccatctcctcagcctccaccaagggcccatcc

SEQ ID NO: 448983 - DNA, 463 bp, Homo sapiens
  misc_feature: HEFZJCU01BE7MJ.10.85.H08.1.454.heavy.3.raw
catagtagtgcacgaccggtgctcgatttagtatcactcagtcgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctccgagagcacagcggccctgggctgcctggtcaaggactacttcccactactatg

SEQ ID NO: 448984 - DNA, 517 bp, Homo sapiens
  misc_feature: HEFZJCU01ECHKF.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccg

SEQ ID NO: 448985 - DNA, 521 bp, Homo sapiens
  misc_feature: HEFZJCU01B7BUZ.12.71.G05.1.454.heavy.3.raw
  modified_base (478)..(478): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagngcacagcggccctgggctgcctggtcaaggactacttcctacg

SEQ ID NO: 448986 - DNA, 470 bp, Homo sapiens; identical to SEQ ID NO: 444866
  misc_feature: HEFZJCU01BC2VP.4.36.D03.1.454.heavy.3.raw

SEQ ID NO: 448987 - DNA, 482 bp, Homo sapiens
  misc_feature: HEFZJCU01C5PP1.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 448988 - DNA, 396 bp, Homo sapiens; identical to SEQ ID NO: 444469
  misc_feature: HEFZJCU01AHIWB.47.46.E02.1.454.heavy.3.raw

SEQ ID NO: 448989 - DNA, 518 bp, Homo sapiens; identical to SEQ ID NO: 446027
  misc_feature: HEFZJCU01DA3IH.9.34.D01.1.454.heavy.3.raw

SEQ ID NO: 448990 - DNA, 490 bp, Homo sapiens
  misc_feature: HEFZJCU01B1SEZ.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctgcgccctgctccaggagcacctccgagagcacagcggccctgggctgcctggtcaaggactacttccgtatctctcg

SEQ ID NO: 448991 - DNA, 396 bp, Homo sapiens
  misc_feature: HEFZJCU01EH4MQ.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgttccaggagcacctccgagagcacagcggccctgggctgcctggtcaaggactacttcctacgtgagct

SEQ ID NO: 448992 - DNA, 379 bp, Homo sapiens; identical to SEQ ID NO: 444450
  misc_feature: HEFZJCU01BK4U9.47.77.G11.1.454.heavy.3.raw

SEQ ID NO: 448993 - DNA, 495 bp, Homo sapiens
  misc_feature: HEFZJCU01CAWWM.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcggtcttcccctggcgccctgctccaggagcacctctgggggcacagcggccctgggctgcctggtcaggactacttcctacgtcgtat

SEQ ID NO: 448994 - DNA, 494 bp, Homo sapiens
  misc_feature: HEFZJCU01AT1KX.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtggttttcgtcgtaggctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgta

SEQ ID NO: 448995 - DNA, 527 bp, Homo sapiens; identical to SEQ ID NO: 446218
  misc_feature: HEFZJCU01ARRGK.9.33.C11.1.454.heavy.3.raw

SEQ ID NO: 448996 - DNA, 511 bp, Homo sapiens
  misc_feature: HEFZJCU01CQW0W.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggcc

SEQ ID NO: 448997 - DNA, 524 bp, Homo sapiens
  misc_feature: HEFZJCU01BNC27.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccctggccg

SEQ ID NO: 448998 - DNA, 429 bp, Homo sapiens
  misc_feature: HEFZJCU01DHKO4.13.78.H01.1.454.heavy.3.raw
tcacgtactacacgaccggtgctcgatttagtgtgagtagtttgggtttgggctcgtccactgacatggtgacgcgactattgagggacgggctggagtggattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttcccctggcgccctgctccaggagcacctccgagagcacagcggccctgggctgcctggtcaaggactacttcctagtacgtga

SEQ ID NO: 448999 - DNA, 521 bp, Homo sapiens; identical to SEQ ID NO: 448417
  misc_feature: HEFZJCU01C2CEP.13.33.C11.1.454.heavy.3.raw

SEQ ID NO: 449000 - DNA, 520 bp, Homo sapiens; identical to SEQ ID NO: 446725
  misc_feature: HEFZJCU01BRH47.12.86.H09.1.454.heavy.3.raw

SEQ ID NO: 449001 - DNA, 527 bp, Homo sapiens
  misc_feature: HEFZJCU01C85C0.21.78.H01.1.454.heavy.3.raw
tcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctcccaccctccaccac

SEQ ID NO: 449002 - DNA, 511 bp, Homo sapiens
  misc_feature: HEFZJCU01CGNCF.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagttgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccg

SEQ ID NO: 449003 - DNA, 514 bp, Homo sapiens
  misc_feature: HEFZJCU01CVJRQ.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcc

SEQ ID NO: 449004 - DNA, 522 bp, Homo sapiens
  misc_feature: HEFZJCU01D7N1V.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttccccctggcgccctgctccaggagcacctccgagagcacagcggccctcgggctgcctggtcaaggactacttcctacg

SEQ ID NO: 449005 - DNA, 504 bp, Homo sapiens; identical to SEQ ID NO: 447065
  misc_feature: HEFZJCU01DK8YY.10.23.C01.1.454.heavy.3.raw

SEQ ID NO: 449006 - DNA, 527 bp, Homo sapiens
  misc_feature: HEFZJCU01CFAJE.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctgggccagggaaccctggtcaccgtctcctcagcctccaccaagggcccatcggtcttcccctggcgccctgctccaggagcacctccgagacg

SEQ ID NO: 449007 - DNA, 481 bp, Homo sapiens; identical to SEQ ID NO: 448054
  misc_feature: HEFZJCU01DEURR.22.36.D03.1.454.heavy.3.raw

SEQ ID NO: 449008 - DNA, 336 bp, Homo sapiens; identical to SEQ ID NO: 444429
  misc_feature: HEFZJCU01AHYPN.14.28.C06.1.454.heavy.3.raw

SEQ ID NO: 449009 - DNA, 497 bp, Homo sapiens
  misc_feature: HEFZJCU01AS3IC.48.37.D04.1.454.heavy.3.raw
agtatacatacacgaccggtgctcgatttagtagcatactgttgggtttggggggaagaggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 449010 - DNA, 508 bp, Homo sapiens
  misc_feature: HEFZJCU01ALGBA.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgacgcctacggcagcggcctttgacctttcgtc

SEQ ID NO: 449011 - DNA, 518 bp, Homo sapiens
  misc_feature: HEFZJCU01EQFEJ.14.66.F11.1.454.heavy.3.raw
cgtctagtaccacgaccggtgctcgatttagtcacgcgagaagggtgccagggggaagaccgatgggcccaggactggtgaagccttcgggagaccctgtccctcacctgcactgtctctggcggctccatcaatacttacaactggacctggatccggcagcccccagggaagggtctgaattggattgggtatatctctaacagtgggaggaccaactacaacccctccctccagagtcgagtcaccatttcattagacacgtccaagaaccagttctccctgaggttgaactctgtgaccgctgcggacacggccgtgtattattgtgcgagggtcggtggccacaatggcgagtacaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 449012 - DNA, 518 bp, Homo sapiens; identical to SEQ ID NO: 446826
  misc_feature: HEFZJCU01BQGSL.52.78.H01.1.454.heavy.3.raw

SEQ ID NO: 449013 - DNA, 415 bp, Homo sapiens; identical to SEQ ID NO: 444794
  misc_feature: HEFZJCU01CM5H3.14.74.G08.1.454.heavy.3.raw

SEQ ID NO: 449014 - DNA, 477 bp, Homo sapiens; identical to SEQ ID NO: 444659
  misc_feature: HEFZJCU01AGKE0.16.10.A10.1.454.heavy.3.raw

SEQ ID NO: 449015 - DNA, 505 bp, Homo sapiens
  misc_feature: HEFZJCU01DKHGR.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcgccctgggctgcctggtcaaggactacttccgagtagtaca

SEQ ID NO: 449016 - DNA, 517 bp, Homo sapiens
  misc_feature: HEFZJCU01CKTHH.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcagctggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccgaagtactcctttgacgtctggggccg

SEQ ID NO: 449017 - DNA, 510 bp, Homo sapiens
  misc_feature: HEFZJCU01ES3N1.47.55.E11.1.454.heavy.3.raw
  modified_base (450)..(450): a, c, t, g, unknown or other
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggntgtctatcattgtgttttcgatgccttcggtccgcgggacttctggggccagggaaccct

SEQ ID NO: 449018 - DNA, 405 bp, Homo sapiens
  misc_feature: HEFZJCU01DGXJJ.11.70.G04.1.454.heavy.3.raw
cgagagataccacgaccggtgctcgatttagtgtagtgtgaagggaaaggggactggagtggattggtcatatcgataccactggaaacaccaattacaacccctccctcaagagtcgagtcaccatatccctgacgtccaagagtcagtctctccctggagtctgacttctgtgaccgccgcagacacggccgtgtattacgtgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcg

SEQ ID NO: 449019 - DNA, 509 bp, Homo sapiens
  misc_feature: HEFZJCU01AOFON.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaagcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggccgccctgctccaggacg

SEQ ID NO: 449020 - DNA, 386 bp, Homo sapiens; identical to SEQ ID NO: 446054
  misc_feature: HEFZJCU01BQI8S.18.60.F05.1.454.heavy.3.raw

SEQ ID NO: 449021 - DNA, 487 bp, Homo sapiens
  misc_feature: HEFZJCU01B110M.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcgccctgctccaggagcacctccgagagcacagcggccctgggctgctggtcaaggactacttcccatactcgta

SEQ ID NO: 449022 - DNA, 515 bp, Homo sapiens
  misc_feature: HEFZJCU01DSTYW.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaacagttctccctgaagctgagctctgtgactgccgcggacacggccgtgtattactgtgcgaggtcgattgtgatggtaacaactgcttcttactcctttgaccagtggggccggggaaccctggtcaccgtctcttcagcctccaccaagggcccatcggtcttcccctggcaccctcctccaagagcacctcgtggggcac

SEQ ID NO: 449023 - DNA, 494 bp, Homo sapiens
  misc_feature: HEFZJCU01B5NQF.14.50.E06.1.454.heavy.3.raw
cgtctagtaccacgaccggtgctcgatttagatctactgacaacacacaaggggacccaacaaccacatccctcctcagaagcccccagagcacaacgcctcaccatggactggacctggaggatcctctttttggtggcagcagccacaggtgcccactcccaggtccaccttgtgcagtctggggctgaggtgaagaagcctggggcctcagtgaaggtttcctgcaaggcttctggatacaccttcaccacctatgttgttcattgggtgcaccaggcccccggacaaaggcttgagtggatgggatggatcaacgctggcaatggtaacacaaaatattcacagatgtttcagggcagagtcaccattaccagggacacatccgcgagcacagtctacatggagctgagcagcctgagatctgaagacacggctgtgtattactgtgcgagagataagaggcggattggcgatttgtggactccggcgct

SEQ ID NO: 449024 - DNA, 482 bp, Homo sapiens
  misc_feature: HEFZJCU01DMODB.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctgcgccctgctccaggagcacctcccgagagcacagcggccctgggctgcctggtcaaggactactcccactactatg

SEQ ID NO: 449025 - DNA, 522 bp, Homo sapiens
  misc_feature: HEFZJCU01DG7R4.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccg

SEQ ID NO: 449026 - DNA, 530 bp, Homo sapiens
  misc_feature: HEFZJCU01CSND6.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccagggaaccctggtcaccgtctcctcacgcctccaaccg

SEQ ID NO: 449027 - DNA, 510 bp, Homo sapiens
  misc_feature: HEFZJCU01BCIA0.48.37.D04.1.454.heavy.3.raw
agtatacatacacgaccggtgctcgatttagtagcatactgttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaaggggacaatggtcaccgtctcttcagcctccaccaaggg

SEQ ID NO: 449028 - DNA, 457 bp, Homo sapiens
  misc_feature: HEFZJCU01C01JP.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgtttatagtgggagctgccccaagatcgccattccactttgactactgggccagggaacactggtcaccgtctcctcagcctccaccaagggcccatcggtcttccccctggcaccctcctccaagagcacctctgggggcacagcggccctgggctgcctggtcaaggactactcctcgtactgcg

SEQ ID NO: 449029 - DNA, 313 bp, Homo sapiens; identical to SEQ ID NO: 444518
  misc_feature: HEFZJCU01DQ2ER.7.10.A10.1.454.heavy.3.raw

SEQ ID NO: 449030 - DNA, 528 bp, Homo sapiens
  misc_feature: HEFZJCU01C73IV.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattaactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggccagggaaccctgggtcaccgtctcctcagcctccaccg

SEQ ID NO: 449031 - DNA, 506 bp, Homo sapiens
  misc_feature: HEFZJCU01DLRSO.48.86.H09.1.454.heavy.3.raw
agtatacatacacgaccggtgctcgatttagtgctatagacttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggacctccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatgtgggccaagggacaatggtcaccgt

SEQ ID NO: 449032 - DNA, 480 bp, Homo sapiens; identical to SEQ ID NO: 445011
  misc_feature: HEFZJCU01AQW7E.22.36.D03.1.454.heavy.3.raw

SEQ ID NO: 449033 - DNA, 493 bp, Homo sapiens
  misc_feature: HEFZJCU01D20AI.43.9.A09.1.454.heavy.3.raw
tgtgagtagtcacgaccggtgctcgatttagcgagacgcgcagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacagggtcaccatgaccagggacacgtccatcaacacaggctacatggacctgagcagcctcagacctgacgacacgggcgtctatttctgtgcgagagtccctatgttgggcccaactggggactttggta

SEQ ID NO: 449034 - DNA, 518 bp, Homo sapiens; identical to SEQ ID NO: 444718
  misc_feature: HEFZJCU01EUKWJ.9.34.D01.1.454.heavy.3.raw

SEQ ID NO: 449035 - DNA, 517 bp, Homo sapiens
  misc_feature: HEFZJCU01AQC87.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttccccctggcgccctgctccaggagcacctccgagagcacagcggccctgggctgcctggtcaaggactacttcc

SEQ ID NO: 449036 - DNA, 489 bp, Homo sapiens; identical to SEQ ID NO: 444791
  misc_feature: HEFZJCU01CWIT0.47.85.H08.1.454.heavy.3.raw

SEQ ID NO: 449037 - DNA, 397 bp, Homo sapiens
  misc_feature: HEFZJCU01CLYAJ.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctggtcaccgtctcctcagcctccaccaagggcccatcggtcttccccctggcgccctgctccaggagcacctccgagagcacagcggccctcgggctgcctggtcaaggactactcctacagtgct

SEQ ID NO: 449038 - DNA, 315 bp, Homo sapiens; identical to SEQ ID NO: 444422
  misc_feature: HEFZJCU01B61L6.47.84.H07.1.454.heavy.3.raw

SEQ ID NO: 449039 - DNA, 510 bp, Homo sapiens
  misc_feature: HEFZJCU01CQNBQ.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgccg

SEQ ID NO: 449040 - DNA, 502 bp, Homo sapiens; identical to SEQ ID NO: 448364
  misc_feature: HEFZJCU01APNWN.13.87.H10.1.454.heavy.3.raw

SEQ ID NO: 449041 - DNA, 534 bp, Homo sapiens
  misc_feature: HEFZJCU01EJBTC.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaaccctggtcaccgtctcctcagcctccaccaagggcccatcggtcttccccctc

SEQ ID NO: 449042 - DNA, 529 bp, Homo sapiens
  misc_feature: HEFZJCU01AUQZM.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggaggtctccgacccagcaactggttcgaccctggggccagggaaccctggtcaccgtctcctcagcctccaccaagggcccatcggtcttcccctcggcaccctcctccaagagcacctctgggggcacacgg

SEQ ID NO: 449043 - DNA, 384 bp, Homo sapiens; identical to SEQ ID NO: 445564
  misc_feature: HEFZJCU01EYRZG.47.29.C07.1.454.heavy.3.raw

SEQ ID NO: 449044 - DNA, 514 bp, Homo sapiens
  misc_feature: HEFZJCU01EZDTT.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgataaccgggaggggttg

SEQ ID NO: 449045 - DNA, 483 bp, Homo sapiens
  misc_feature: HEFZJCU01BOSU0.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggccgccctgcctccaggagccacctccgagagcacagcggccctgggctgcctggtcaaggactacttccagacgtatca

SEQ ID NO: 449046 - DNA, 482 bp, Homo sapiens; identical to SEQ ID NO: 444503
  misc_feature: HEFZJCU01COUNV.7.10.A10.1.454.heavy.3.raw

SEQ ID NO: 449047 - DNA, 512 bp, Homo sapiens
  misc_feature: HEFZJCU01EY350.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacgggcaggcggcctttgacttctgggggccaggggacg

SEQ ID NO: 449048 - DNA, 506 bp, Homo sapiens
  misc_feature: HEFZJCU01DPL49.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctggggcacagcggccctggctgcctggtcaggactactcccata

SEQ ID NO: 449049 - DNA, 497 bp, Homo sapiens; identical to SEQ ID NO: 445179
  misc_feature: HEFZJCU01CBPZY.12.55.E11.1.454.heavy.3.raw

SEQ ID NO: 449050 - DNA, 520 bp, Homo sapiens
  misc_feature: HEFZJCU01DRO3I.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttcccctggcg

SEQ ID NO: 449051 - DNA, 539 bp, Homo sapiens
  misc_feature: HEFZJCU01DQYZP.52.9.A09.1.454.heavy.3.raw
cgcagtacgacacgaccggtgctcgatttagcgagacgcgcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctggggccaagggaccacggtcaccgtctcctcagcctccaccaagggcccatcggtcttccccctc

SEQ ID NO: 449052 - DNA, 495 bp, Homo sapiens
  misc_feature: HEFZJCU01CSUGA.16.37.D04.1.454.heavy.3.raw
tgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 449053 - DNA, 482 bp, Homo sapiens; identical to SEQ ID NO: 444503
  misc_feature: HEFZJCU01EXBR5.7.10.A10.1.454.heavy.3.raw

SEQ ID NO: 449054 - DNA, 465 bp, Homo sapiens
  misc_feature: HEFZJCU01CP384.48.33.C11.1.454.heavy.3.raw
agtatacatacacgaccggtgctcgatttagagtgagctcgttgggtttggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 449055 - DNA, 395 bp, Homo sapiens; identical to SEQ ID NO: 448398
  misc_feature: HEFZJCU01BG4ZD.47.46.E02.1.454.heavy.3.raw

SEQ ID NO: 449056 - DNA, 523 bp, Homo sapiens
  misc_feature: HEFZJCU01EMOL2.40.38.D05.1.454.heavy.3.raw
  modified_base (502)..(502): a, c, t, g, unknown or other
tctagcgactcacgaccggtgctcgatttagtatctgatagttgggtttggggagctctgagagaggagcccagccctgggattttcaggtgttttcatttggtgatcaggactgaacagagagaactcaccatggagtttgggctgagcgtggcgttttcttagtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgcgactccgtgaagggccggttcaccatctccagagacaacgccaagaacacagtgtctctgcaaatggacagtctgagagccgaggacacgggtgtctattattgtacaaaagtggggactaatgaatanggtgtggacgtcgtgggaccg

SEQ ID NO: 449057 - DNA, 518 bp, Homo sapiens
  misc_feature: HEFZJCU01AN2NC.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggcctgggctgcctggtcaaggactacttccgagtagtaca

SEQ ID NO: 449058 - DNA, 489 bp, Homo sapiens
  misc_feature: HEFZJCU01B2BLF.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtat

SEQ ID NO: 449059 - DNA, 529 bp, Homo sapiens
  misc_feature: HEFZJCU01CPDTK.7.78.H01.1.454.heavy.3.raw
  modified_base (507)..(507): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattgactactggggccagggaaccctggtcnccgtctcctcagcctccaccaa

SEQ ID NO: 449060 - DNA, 482 bp, Homo sapiens; identical to SEQ ID NO: 445520
  misc_feature: HEFZJCU01EZ0TQ.10.35.D02.1.454.heavy.3.raw

SEQ ID NO: 449061 - DNA, 502 bp, Homo sapiens; identical to SEQ ID NO: 445414
  misc_feature: HEFZJCU01DHBZM.17.25.C03.1.454.heavy.3.raw

SEQ ID NO: 449062 - DNA, 488 bp, Homo sapiens
  misc_feature: HEFZJCU01BH404.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctgcgccctgctccaggagcacctccgagagcacagcggccctgggctgcctggtcaaggactacttcctacgtgagct

SEQ ID NO: 449063 - DNA, 399 bp, Homo sapiens
  misc_feature: HEFZJCU01CHH1N.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaagactacttcctacgtgagct

SEQ ID NO: 449064 - DNA, 525 bp, Homo sapiens
  misc_feature: HEFZJCU01CEU7G.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcacgcct

SEQ ID NO: 449065 - DNA, 519 bp, Homo sapiens; identical to SEQ ID NO: 445330
  misc_feature: HEFZJCU01BGSEJ.7.78.H01.1.454.heavy.3.raw

SEQ ID NO: 449066 - DNA, 484 bp, Homo sapiens
  misc_feature: HEFZJCU01AUJA6.52.4.A04.1.454.heavy.3.raw
cgcagtacgacacgaccggtgctcgatttagagtagtgatcaggactggtgaagccttcacagaccctgtccctcacctgcactgtctctggttactccatcagcagtcctgatcactattggagttggatccgccagtccccagggaagggcctggagtggattggatacatttattacagcgggcgcagcaactatagcccgtccctcaggactccagttaccatatcaatagacacgtccaagaaccagttctcactgattctgacctctgtgactgccgcagacacggccgtttactactgtgccagggcccactacgatttcgtttacgtggattcctggggccagggagccctggtcaccgtctccgcggcctccaccaagggcccatcggtcttcccctggcaccctcctccaagagcacctctgggggcacagcggccctgggctgcctggtcaaggactacttcctatacgatcg

SEQ ID NO: 449067 - DNA, 324 bp, Homo sapiens
  misc_feature: HEFZJCU01AY61H.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcaccctcctccaagagcacctctgggggcacagcggccctgggctgcctggtcaaggactacttcccatactcgta

SEQ ID NO: 449068 - DNA, 396 bp, Homo sapiens; identical to SEQ ID NO: 444469
  misc_feature: HEFZJCU01BGUBD.47.46.E02.1.454.heavy.3.raw

SEQ ID NO: 449069 - DNA, 449 bp, Homo sapiens; identical to SEQ ID NO: 444889
  misc_feature: HEFZJCU01ELL2E.9.53.E09.1.454.heavy.3.raw

SEQ ID NO: 449070 - DNA, 483 bp, Homo sapiens; identical to SEQ ID NO: 444924
  misc_feature: HEFZJCU01C0TSK.10.35.D02.1.454.heavy.3.raw

SEQ ID NO: 449071 - DNA, 505 bp, Homo sapiens; identical to SEQ ID NO: 447076
  misc_feature: HEFZJCU01C111F.10.38.D05.1.454.heavy.3.raw

SEQ ID NO: 449072 - DNA, 501 bp, Homo sapiens
  misc_feature: HEFZJCU01B2KE8.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctccgagagcacagcggccctgggctgcctggtcaggactacttcccgagcgacga

SEQ ID NO: 449073 - DNA, 509 bp, Homo sapiens
  misc_feature: HEFZJCU01CT5B5.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcagtttgggggagtcatcgt

SEQ ID NO: 449074 - DNA, 396 bp, Homo sapiens; identical to SEQ ID NO: 444568
  misc_feature: HEFZJCU01CI1I9.47.46.E02.1.454.heavy.3.raw

SEQ ID NO: 449075 - DNA, 483 bp, Homo sapiens; identical to SEQ ID NO: 444639
  misc_feature: HEFZJCU01DVL2J.11.23.C01.1.454.heavy.3.raw

SEQ ID NO: 449076 - DNA, 489 bp, Homo sapiens
  misc_feature: HEFZJCU01BYGFJ.15.8.A08.1.454.heavy.3.raw
tctacgtagccacgaccggtgctcgatttagcatactctacaggggtccctgagactctcctgtgccgcctctggagcagagtctgaattcaccttcatgcactttgccatgagctgggtccgccaggctccggggaaggggctggagtgcgtcgcatgtataactaaaagtggagacatcacactctacgcagactccgtgaagggccgcttcaccatctccagagacaactccaagaacacgctgtccctggagatgaacagcctgagagccgaggacacggccatttattactgtgcgaaagatagttcggggagtaattatcgagaatactattttgactcctggggccagggagccctggtcaccgtctcctcagcctccaccaagggcccatcggtcttccccctggcaccctcctccaagagcacctctgggggcacagcggccctgggctgcctggtcaaggactacttccgctacgtaga

SEQ ID NO: 449077 - DNA, 519 bp, Homo sapiens
  misc_feature: HEFZJCU01BMUG0.12.40.D07.1.454.heavy.3.raw
atacgacgtacacgaccggtgctcgatttagtgatagagcgtaacaacagaggactcaccatggagtttgggctgagcgtggtttcgtcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggccctggtcatcgtctccccagcctccaccaagggcccatcggtcttcccctggc

SEQ ID NO: 449078 - DNA, 500 bp, Homo sapiens
  misc_feature: HEFZJCU01EGPH6.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggaatgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 449079 - DNA, 486 bp, Homo sapiens; identical to SEQ ID NO: 444861
  misc_feature: HEFZJCU01C96XW.47.55.E11.1.454.heavy.3.raw

SEQ ID NO: 449080 - DNA, 536 bp, Homo sapiens
  misc_feature: HEFZJCU01EADIU.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggagccctggtctaccg

SEQ ID NO: 449081 - DNA, 485 bp, Homo sapiens
  misc_feature: HEFZJCU01CQIN6.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacaacg

SEQ ID NO: 449082 - DNA, 524 bp, Homo sapiens
  misc_feature: HEFZJCU01D8RTE.12.86.H09.1.454.heavy.3.raw
  modified_base (380)..(380): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttcngtgcgagtcttgatagtagtggttatcctgaatactggggccagggaaccctggtgaccgtctcctcagcctccaccaagggcccatcggtcttcccctgcgccctgctccaggagcacctccgagagcacagccggccctggg

SEQ ID NO: 449083 - DNA, 508 bp, Homo sapiens; identical to SEQ ID NO: 446002
  misc_feature: HEFZJCU01DG17E.9.78.H01.1.454.heavy.3.raw

SEQ ID NO: 449084 - DNA, 522 bp, Homo sapiens
  misc_feature: HEFZJCU01DVDR7.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattctaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaatttctggtaccacatactactccgaccccgtgaaggggccgattaaccatctccagagacgattccgagaacacggtgtatcttcaaatgaacaacctgagagccgacgacacggccgtttatactgtgcgagagattcgagtggttcggggacctcgccctggttctcttcgatctctgggccgt

SEQ ID NO: 449085 - DNA, 505 bp, Homo sapiens
  misc_feature: HEFZJCU01DRHS5.9.86.H09.1.454.heavy.3.raw
tgatacgtctcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcaccgtctcttcagcctccaccaagggcccatcggtcttcccctggcgcctgctccaggacg

SEQ ID NO: 449086 - DNA, 402 bp, Homo sapiens; identical to SEQ ID NO: 444584
  misc_feature: HEFZJCU01DFXAB.10.77.G11.1.454.heavy.3.raw

SEQ ID NO: 449087 - DNA, 400 bp, Homo sapiens; identical to SEQ ID NO: 444452
  misc_feature: HEFZJCU01D7P42.47.24.C02.1.454.heavy.3.raw

SEQ ID NO: 449088 - DNA, 509 bp, Homo sapiens
  misc_feature: HEFZJCU01DHQVK.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctgggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagactcactgtatctgcaaatgaacagcctaagacccgaggacacggctgtgtattactgtgcgagagaccgctacgtggggcccgggagccctgggt

SEQ ID NO: 449089 - DNA, 352 bp, Homo sapiens; identical to SEQ ID NO: 444485
  misc_feature: HEFZJCU01ANX7B.10.38.D05.1.454.heavy.3.raw

SEQ ID NO: 449090 - DNA, 496 bp, Homo sapiens
  misc_feature: HEFZJCU01CCODT.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgcttacttttc

SEQ ID NO: 449091 - DNA, 504 bp, Homo sapiens
  misc_feature: HEFZJCU01C8ZJF.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtaccg

SEQ ID NO: 449092 - DNA, 538 bp, Homo sapiens
  misc_feature: HEFZJCU01CIWBX.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggacttggttctcccatggaatccctactttgagtactggggccgcggagcctggtcaccgtctcctcagcctccaccaagggcccatcggtcttcccctggcaccct

SEQ ID NO: 449093 - DNA, 485 bp, Homo sapiens
  misc_feature: HEFZJCU01DEIDE.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaagggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattacta

SEQ ID NO: 449094 - DNA, 508 bp, Homo sapiens
  misc_feature: HEFZJCU01D6KS0.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaacctccctgtatctgacaaatgaacagcctgagagctgaggacacggccttgtattattgtgacaaaagactacccaaccccttacgtt

SEQ ID NO: 449095 - DNA, 463 bp, Homo sapiens; identical to SEQ ID NO: 446208
  misc_feature: HEFZJCU01ENKTG.19.10.A10.1.454.heavy.3.raw

SEQ ID NO: 449096 - DNA, 521 bp, Homo sapiens
  misc_feature: HEFZJCU01AWSDO.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctacaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaacccg

SEQ ID NO: 449097 - DNA, 491 bp, Homo sapiens; identical to SEQ ID NO: 444592
  misc_feature: HEFZJCU01B6R1P.11.26.C04.1.454.heavy.3.raw

SEQ ID NO: 449098 - DNA, 513 bp, Homo sapiens; identical to SEQ ID NO: 446452
  misc_feature: HEFZJCU01BB1QE.17.33.C11.1.454.heavy.3.raw

SEQ ID NO: 449099 - DNA, 517 bp, Homo sapiens
  misc_feature: HEFZJCU01C7HW0.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctccccaagagcacctctgggggcacagcggcctgggctgcctggtcaaggactacttccagacgtatca

SEQ ID NO: 449100 - DNA, 396 bp, Homo sapiens; identical to SEQ ID NO: 444469
  misc_feature: HEFZJCU01DMEE2.47.46.E02.1.454.heavy.3.raw

SEQ ID NO: 449101 - DNA, 403 bp, Homo sapiens
  misc_feature: HEFZJCU01CW9ZL.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattggtgcgagaggggcacctcggtccgcttattactaccactcctacttggacgtctggggcaaagggaccgcggtcaccgtctcctcagcctccaccaagggcccatcggtcttccccctggcgccctgctccacggagcacctccgagagcacagcggccctgggctgcctggtcaaggactacttcctacgtgagtct

SEQ ID NO: 449102 - DNA, 494 bp, Homo sapiens
  misc_feature: HEFZJCU01A3PXV.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggcccatcggtcttcccctggcgccctgctccaggagcacctctgggggcacagcggccctgggctgcctggtcaaggactacttccctacagtgct

SEQ ID NO: 449103 - DNA, 508 bp, Homo sapiens; identical to SEQ ID NO: 445594
  misc_feature: HEFZJCU01CS3RW.17.25.C03.1.454.heavy.3.raw

SEQ ID NO: 449104 - DNA, 512 bp, Homo sapiens
  misc_feature: HEFZJCU01CM9UV.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctggg

SEQ ID NO: 449105 - DNA, 500 bp, Homo sapiens
  misc_feature: HEFZJCU01CM7TA.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttcttggtatttcgatctctggggccgtggcaccctggtcactgtctcctcggcttccaccaagggcccatcggtcttcccctgcgcctgctccagagcacctctggggc

SEQ ID NO: 449106 - DNA, 495 bp, Homo sapiens
  misc_feature: HEFZJCU01COPV7.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggca

SEQ ID NO: 449107 - DNA, 491 bp, Homo sapiens; identical to SEQ ID NO: 444749
  misc_feature: HEFZJCU01ERFDF.11.13.B02.1.454.heavy.3.raw

SEQ ID NO: 449108 - DNA, 400 bp, Homo sapiens; identical to SEQ ID NO: 444452
  misc_feature: HEFZJCU01DAWE2.47.24.C02.1.454.heavy.3.raw

SEQ ID NO: 449109 - DNA, 400 bp, Homo sapiens
  misc_feature: HEFZJCU01B1OGW.13.4.A04.1.454.heavy.3.raw
tcacgtactacacgaccggtgctcgatttagagtagtgatcagggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 449110 - DNA, 531 bp, Homo sapiens
  misc_feature: HEFZJCU01BZE3A.17.34.D01.1.454.heavy.3.raw
cgtagactagcacgaccggtgctcgatttagatcgtctgtgttgggtttggggacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaaccccggtcaccgt

SEQ ID NO: 449111 - DNA, 497 bp, Homo sapiens
  misc_feature: HEFZJCU01EG7IA.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgtatacttattgtaggtggtggtacctgcttacttttggttcgaccctggggccaggggaaccctggt

SEQ ID NO: 449112 - DNA, 501 bp, Homo sapiens
  misc_feature: HEFZJCU01D0PHU.17.10.A10.1.454.heavy.3.raw
  modified_base (443)..(443): a, c, t, g, unknown or other
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattacngtgcgagaatgttttcngtcatcgtacaatttgaatggctctatggactggacttctc

SEQ ID NO: 449113 - DNA, 484 bp, Homo sapiens
  misc_feature: HEFZJCU01B1B72.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 449114 - DNA, 500 bp, Homo sapiens; identical to SEQ ID NO: 445720
  misc_feature: HEFZJCU01C4GCG.3.20.B09.1.454.heavy.3.raw

SEQ ID NO: 449115 - DNA, 409 bp, Homo sapiens; identical to SEQ ID NO: 444519
  misc_feature: HEFZJCU01CSCRJ.3.41.D08.1.454.heavy.3.raw

SEQ ID NO: 449116 - DNA, 507 bp, Homo sapiens
  misc_feature: HEFZJCU01BZPJS.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 449117 - DNA, 516 bp, Homo sapiens; identical to SEQ ID NO: 445479
  misc_feature: HEFZJCU01CAZHL.9.34.D01.1.454.heavy.3.raw

SEQ ID NO: 449118 - DNA, 517 bp, Homo sapiens
  misc_feature: HEFZJCU01EFZA9.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttctagcactggggccac

SEQ ID NO: 449119 - DNA, 509 bp, Homo sapiens; identical to SEQ ID NO: 446792
  misc_feature: HEFZJCU01BPX78.18.39.D06.1.454.heavy.3.raw

SEQ ID NO: 449120 - DNA, 515 bp, Homo sapiens
  misc_feature: HEFZJCU01DRLWV.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagacttcgtgaagggccgattcaccatctccagagacaattccaggaacacaatgtatttggagctgaacagcctaagtcctgaggacacgggcgtatactactgtacgaaggagggggaaccgagcgggagttccaagtactcctttgtacg

SEQ ID NO: 449121 - DNA, 485 bp, Homo sapiens
  misc_feature: HEFZJCU01ELARU.51.38.D05.1.454.heavy.3.raw
cgatcgtatacacgaccggtgctcgatttagtatctgatagttgggtttgggcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtc

SEQ ID NO: 449122 - DNA, 492 bp, Homo sapiens
  misc_feature: HEFZJCU01C3Z9S.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgcgacagaaagagattccatactcaggcgggggcactatggcagcagctg

SEQ ID NO: 449123 - DNA, 513 bp, Homo sapiens
  misc_feature: HEFZJCU01D3OYQ.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaacctacctgctatctgagctggttcgactgctggggccagggaaccctggtctaccg

SEQ ID NO: 449124 - DNA, 500 bp, Homo sapiens
  misc_feature: HEFZJCU01BWMBK.10.71.G05.1.454.heavy.3.raw
  modified_base (443)..(443): a, c, t, g, unknown or other
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctganagccgaggacacgggtgtttattactgtgggagaaatcctagtggcatcacctggta

SEQ ID NO: 449125 - DNA, 503 bp, Homo sapiens
  misc_feature: HEFZJCU01DAY5G.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctctgacgacacggccatgtattactgttggaagagacgttggtggctaccgcggggctggaccactggggccg

SEQ ID NO: 449126 - DNA, 400 bp, Homo sapiens; identical to SEQ ID NO: 444452
  misc_feature: HEFZJCU01EK6EK.47.24.C02.1.454.heavy.3.raw

SEQ ID NO: 449127 - DNA, 500 bp, Homo sapiens; identical to SEQ ID NO: 446033
  misc_feature: HEFZJCU01CQCPS.11.27.C05.1.454.heavy.3.raw

SEQ ID NO: 449128 - DNA, 398 bp, Homo sapiens; identical to SEQ ID NO: 444524
  misc_feature: HEFZJCU01CS3R3.7.60.F05.1.454.heavy.3.raw

SEQ ID NO: 449129 - DNA, 382 bp, Homo sapiens; identical to SEQ ID NO: 447449
  misc_feature: HEFZJCU01D1BBK.53.27.C05.1.454.heavy.3.raw

SEQ ID NO: 449130 - DNA, 481 bp, Homo sapiens
  misc_feature: HEFZJCU01A0KJ5.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcgtcttcccctggcgccctgctccaggagcacctccgagagcacagcggccctgggctgcctggtcaaggactactcccactactatg

SEQ ID NO: 449131 - DNA, 537 bp, Homo sapiens
  misc_feature: HEFZJCU01BLSSF.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagtgggagcaccaactacaaccctccctcaagagtcgagtcaccatatcagtggacacgtccaagaaccagttctccctgaagctgagctctgtgaccgctgcggacacggccgtgtattactgtgcgagctggggttcagggtactttgactactggggccagggaaccctggtcaccgtctcctcagcctccaccaagggcccatcggtcttccccctggccaccctcctccaacgagccacctctcgggggcacgagcggccctgggctgcctggtcaaggactacttccgtactagacgtcg

SEQ ID NO: 449132 - DNA, 498 bp, Homo sapiens
  misc_feature: HEFZJCU01DQZ1O.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaattttcgttattgttctggtgtgtgtgttcaatgtttg

SEQ ID NO: 449133 - DNA, 517 bp, Homo sapiens
  misc_feature: HEFZJCU01EGRFJ.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggagggggaaccaggcgggagttccaagtactcctttgacgtctggggcctac

SEQ ID NO: 449134 - DNA, 376 bp, Homo sapiens
  misc_feature: HEFZJCU01DGHET.10.38.D05.1.454.heavy.3.raw
catagtagtgcacgaccggtgctcgatttagtatctgatagttgttggaagtgtctctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 449135 - DNA, 528 bp, Homo sapiens
  misc_feature: HEFZJCU01BPE1Z.9.33.C11.1.454.heavy.3.raw
tgatacgtctcacgaccggtgctcgatttagagtgagctcgttgggtttgggctgagcgtggtttcgtcgtaggctctttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggagtacagtggcagctccaagtactactttgacttctggggccagggaaccctggtcaccgtctcctcagcctccaccaagggcccatcggtcttccccctggcgccctgctccaggagcacctccgagacg

SEQ ID NO: 449136 - DNA, 496 bp, Homo sapiens
  misc_feature: HEFZJCU01A8GC8.49.35.D02.1.454.heavy.3.raw
agtcgagagacacgaccggtgctcgatttagcacacgatagttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcattatg

SEQ ID NO: 449137 - DNA, 490 bp, Homo sapiens
  misc_feature: HEFZJCU01CTY18.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactacttccgtatctctcg

SEQ ID NO: 449138 - DNA, 503 bp, Homo sapiens
  misc_feature: HEFZJCU01A26ZP.48.53.E09.1.454.heavy.3.raw
agtatacatacacgaccggtgctcgatttagagagagtgtgttgggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggg

SEQ ID NO: 449139 - DNA, 538 bp, Homo sapiens
  misc_feature: HEFZJCU01AQGHB.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggttttggactggttctcccatggaatccctactttgagtactggggccgcggagccctggtcaccgtctcctcagcctccaccaagggcccatcggtcttcccctggccaccct

SEQ ID NO: 449140 - DNA, 519 bp, Homo sapiens; identical to SEQ ID NO: 444867
  misc_feature: HEFZJCU01B9FQ7.9.34.D01.1.454.heavy.3.raw

SEQ ID NO: 449141 - DNA, 464 bp, Homo sapiens; identical to SEQ ID NO: 445533
  misc_feature: HEFZJCU01AKUZ7.19.10.A10.1.454.heavy.3.raw

SEQ ID NO: 449142 - DNA, 507 bp, Homo sapiens
  misc_feature: HEFZJCU01EE940.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccggggggacgacatgactacc

SEQ ID NO: 449143 - DNA, 497 bp, Homo sapiens; identical to SEQ ID NO: 444995
  misc_feature: HEFZJCU01A5G41.4.26.C04.1.454.heavy.3.raw

SEQ ID NO: 449144 - DNA, 519 bp, Homo sapiens; identical to SEQ ID NO: 445330
  misc_feature: HEFZJCU01COIDY.7.78.H01.1.454.heavy.3.raw

SEQ ID NO: 449145 - DNA, 499 bp, Homo sapiens
  misc_feature: HEFZJCU01DNZT2.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttc

SEQ ID NO: 449146 - DNA, 513 bp, Homo sapiens
  misc_feature: HEFZJCU01EJKTW.52.33.C11.1.454.heavy.3.raw
cgcagtacgacacgaccggtgctcgattagagtgagctcgttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctaccggctgctacttcgatctctgggccgtggcaccctggtcactgtcttctcagcctccaccaagggcccatcggtcttcccctggccaccctcctccaagagcacctctggggcacagcgcccgtggctgcctggtcaaggactacttcctatacg

SEQ ID NO: 449147 - DNA, 515 bp, Homo sapiens
  misc_feature: HEFZJCU01EW0TA.13.61.F06.1.454.heavy.3.raw
tcacgtactacacgaccggtgctcgatttagctacgctctaagggaaagggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttcccctggcgccctgctccaggagcacctctgggggcacagcggcctgggctgcctggtcaaggactactccgtactagacg

SEQ ID NO: 449148 - DNA, 463 bp, Homo sapiens
  misc_feature: HEFZJCU01C304N.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttcccctggcgccctgctccaggagcacctccgagagcacagcggccctgggctgcctggtcaaggctacttcccacgagagta

SEQ ID NO: 449149 - DNA, 402 bp, Homo sapiens; identical to SEQ ID NO: 444815
  misc_feature: HEFZJCU01BCNYT.11.70.G04.1.454.heavy.3.raw

SEQ ID NO: 449150 - DNA, 525 bp, Homo sapiens
  misc_feature: HEFZJCU01B8DG4.5.33.C11.1.454.heavy.3.raw
atcagacacgcacgaccggtgctcgatttagagtgagctcgttgggtttgggggaggcttgggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactacttcccgtgtctgat

SEQ ID NO: 449151 - DNA, 469 bp, Homo sapiens
  misc_feature: HEFZJCU01ESYZE.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttcctacagtgct

SEQ ID NO: 449152 - DNA, 497 bp, Homo sapiens; identical to SEQ ID NO: 446073
  misc_feature: HEFZJCU01C0UKR.22.78.H01.1.454.heavy.3.raw

SEQ ID NO: 449153 - DNA, 525 bp, Homo sapiens
  misc_feature: HEFZJCU01CH1IX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatccggtcttccccctggccg

SEQ ID NO: 449154 - DNA, 556 bp, Homo sapiens
  misc_feature: HEFZJCU01CPTYT.15.86.H09.1.454.heavy.3.raw
tctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccagggacaatggtcgtcgtctcttcagcctccaccaagggcccatcggtcttcccctggcaccctcctcc

SEQ ID NO: 449155 - DNA, 522 bp, Homo sapiens
  misc_feature: HEFZJCU01DUYDT.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttccccctggcgccctgctccaggagcacctccgagagcacagcggccctgggctgcctggtcaaggactacttcctacg

SEQ ID NO: 449156 - DNA, 379 bp, Homo sapiens; identical to SEQ ID NO: 444773
  misc_feature: HEFZJCU01DX3X5.3.59.F04.1.454.heavy.3.raw

SEQ ID NO: 449157 - DNA, 518 bp, Homo sapiens; identical to SEQ ID NO: 444718
  misc_feature: HEFZJCU01BTIMG.9.34.D01.1.454.heavy.3.raw

SEQ ID NO: 449158 - DNA, 371 bp, Homo sapiens; identical to SEQ ID NO: 444919
  misc_feature: HEFZJCU01CTO7W.3.1.A01.1.454.heavy.3.raw

SEQ ID NO: 449159 - DNA, 514 bp, Homo sapiens
  misc_feature: HEFZJCU01D95UI.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaaggtcaccgtctcctcagcctccaccaagggcccatcggtcttcccctggcgccctgctccaggagcacctccgagagcacagcggccctgggctgcctggtcaaggactacttccagacgtatca

SEQ ID NO: 449160 - DNA, 513 bp, Homo sapiens
  misc_feature: HEFZJCU01A1O3D.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcgttttcttaggtggctattttaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccac

SEQ ID NO: 449161 - DNA, 498 bp, Homo sapiens; identical to SEQ ID NO: 445952
  misc_feature: HEFZJCU01A8GKM.11.71.G05.1.454.heavy.3.raw

SEQ ID NO: 449162 - DNA, 528 bp, Homo sapiens
  misc_feature: HEFZJCU01BUYB4.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtctt

SEQ ID NO: 449163 - DNA, 509 bp, Homo sapiens; identical to SEQ ID NO: 445824
  misc_feature: HEFZJCU01EVFQZ.9.14.B03.1.454.heavy.3.raw

SEQ ID NO: 449164 - DNA, 517 bp, Homo sapiens
  misc_feature: HEFZJCU01ATUET.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaggactcttccagacgtatca

SEQ ID NO: 449165 - DNA, 523 bp, Homo sapiens
  misc_feature: HEFZJCU01DCM99.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctgcaccctcctccaagagcacctctgggggcacagcggcctgggctgcctgtcaaggactacttccg

SEQ ID NO: 449166 - DNA, 524 bp, Homo sapiens; identical to SEQ ID NO: 446153
  misc_feature: HEFZJCU01BUX8R.12.86.H09.1.454.heavy.3.raw

SEQ ID NO: 449167 - DNA, 501 bp, Homo sapiens; identical to SEQ ID NO: 445027
  misc_feature: HEFZJCU01D4UXI.26.23.C01.1.454.heavy.3.raw

SEQ ID NO: 449168 - DNA, 450 bp, Homo sapiens; identical to SEQ ID NO: 444893
  misc_feature: HEFZJCU01E17N7.53.57.F02.1.454.heavy.3.raw

SEQ ID NO: 449169 - DNA, 488 bp, Homo sapiens
  misc_feature: HEFZJCU01AGYJ4.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggcccctgtatttttgtgcgagagagtctattaaagtggctt

SEQ ID NO: 449170 - DNA, 530 bp, Homo sapiens
  misc_feature: HEFZJCU01BJ8KR.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccaac

SEQ ID NO: 449171 - DNA, 324 bp, Homo sapiens; identical to SEQ ID NO: 444475
  misc_feature: HEFZJCU01BML70.18.17.B06.1.454.heavy.3.raw

SEQ ID NO: 449172 - DNA, 511 bp, Homo sapiens
  misc_feature: HEFZJCU01C6MVK.18.39.D06.1.454.heavy.3.raw
  modified_base (445)..(445): a, c, t, g, unknown or other
tacgagtatgcacgaccggtgctcgatttagtgacatctcgcagttctggggctgaggtgaagaaccctgggcctcagtgaaggtcttcctgtcagacctatggattccccttccagaattttgatatccattgggtgcgacaggccagtggacaagggctcgagtggatgggatggatgaacggtaaaactgccaacacaggcgtatgcagaggcagttccagggcagagtcaccatgaccgggaacccctccaccggcacagcctacatggagctgagcagtctgacaccgtgacgacacggccgtctattactgtgcgagagccgcgaatatgtggtgcaaagatggtcgtttgtttgttttggccggtgaactactggggccagggcaccctggtcaccgtctcctcagcttcaccaagggcccatcggtctcccctggcnccctgctccaggagcacctctggggcacagcgcccgtggctgcctggtcaggactacttccatacc

SEQ ID NO: 449173 - DNA, 507 bp, Homo sapiens
  misc_feature: HEFZJCU01BG766.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagcctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaggagggggaaccagcggagtccagtactcttg

SEQ ID NO: 449174 - DNA, 530 bp, Homo sapiens
  misc_feature: HEFZJCU01EW0CE.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttggggtttttttttcgttactacgggat

SEQ ID NO: 449175 - DNA, 451 bp, Homo sapiens
  misc_feature: HEFZJCU01DUWJ3.51.37.D04.1.454.heavy.3.raw
cgatcgtatacacgaccggtgctcgatttagtagcatactgttgggtttggggttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttcctcgtagcact

SEQ ID NO: 449176 - DNA, 526 bp, Homo sapiens
  misc_feature: HEFZJCU01ET63U.9.78.H01.1.454.heavy.3.raw
  modified_base (475)..(475): a, c, t, g, unknown or other
  modified_base (487)..(487): a, c, t, g, unknown or other
  modified_base (492)..(492): a, c, t, g, unknown or other
tgatacgtctcacgaccggtgctcgatttagtgtgagtagtttgggtttgggtgccgaagttgctggaggtcacggtcaccacgctgctgagggaggtagggtccctgaggactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggngcacctccgagngcacngcggccctgggctgcctggtcaaggactacttcc

SEQ ID NO: 449177 - DNA, 314 bp, Homo sapiens; identical to SEQ ID NO: 444774
  misc_feature: HEFZJCU01EMX9W.7.10.A10.1.454.heavy.3.raw

SEQ ID NO: 449178 - DNA, 470 bp, Homo sapiens
  misc_feature: HEFZJCU01EE0X6.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagtggccctgggctgcctggtcaaggactacttccctacagtgct

SEQ ID NO: 449179 - DNA, 506 bp, Homo sapiens
  misc_feature: HEFZJCU01DPHCG.8.38.D05.1.454.heavy.3.raw
  modified_base (292)..(292): a, c, t, g, unknown or other
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccnccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtgcagctcaagtacttac

SEQ ID NO: 449180 - DNA, 496 bp, Homo sapiens
  misc_feature: HEFZJCU01DOBEO.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctggggcacagcggccctgggctgcctggtcaaggactacttcctcgtagcact

SEQ ID NO: 449181 - DNA, 520 bp, Homo sapiens
  misc_feature: HEFZJCU01DR3ZT.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggacgcacctcgtcggggggcacacgcggtcccg

SEQ ID NO: 449182 - DNA, 491 bp, Homo sapiens; identical to SEQ ID NO: 446104
  misc_feature: HEFZJCU01CH6RG.3.34.D01.1.454.heavy.3.raw

SEQ ID NO: 449183 - DNA, 526 bp, Homo sapiens
  misc_feature: HEFZJCU01AZ3WI.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacgacgggtgtatactactgtacggaagggaggggggaaccgaggcgggagttccaagtactcctttgacgtcgtc

SEQ ID NO: 449184 - DNA, 432 bp, Homo sapiens; identical to SEQ ID NO: 444920
  misc_feature: HEFZJCU01E0GQ4.11.39.D06.1.454.heavy.3.raw

SEQ ID NO: 449185 - DNA, 504 bp, Homo sapiens
  misc_feature: HEFZJCU01C7HVW.49.57.F02.1.454.heavy.3.raw
agtcgagagacacgaccggtgctcgatttagctcgatatagttgggtttggggctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccgggaaggtctggagtgggctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgacca

SEQ ID NO: 449186 - DNA, 516 bp, Homo sapiens
  misc_feature: HEFZJCU01DAZI2.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgttcttcaatgaacagcctgagagccgatggacacggccgtgtattactgtgcgagagatggggcccacgaacgttactacgctatggacgtctggggccaagggacc

SEQ ID NO: 449187 - DNA, 403 bp, Homo sapiens; identical to SEQ ID NO: 445029
  misc_feature: HEFZJCU01D912F.10.77.G11.1.454.heavy.3.raw

SEQ ID NO: 449188 - DNA, 483 bp, Homo sapiens
  misc_feature: HEFZJCU01BLY47.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctcggcaccctcctccaagagcacctctgggggcacagcggccctgggctgcctggtcaaggactacttcctagagacacg

SEQ ID NO: 449189 - DNA, 492 bp, Homo sapiens
  misc_feature: HEFZJCU01CHXOE.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggtttcgtcgttaggctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 449190 - DNA, 510 bp, Homo sapiens
  misc_feature: HEFZJCU01DIGK3.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggtttcctgttgctctttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggtacttcgtggggccagggtaacccg

SEQ ID NO: 449191 - DNA, 444 bp, Homo sapiens
  misc_feature: HEFZJCU01DAG5C.3.86.H09.1.454.heavy.3.raw
agacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctgggggcacagcggccctgggctgcctggtcaaggctacttccgagtgcgtct

SEQ ID NO: 449192 - DNA, 495 bp, Homo sapiens
  misc_feature: HEFZJCU01CRBMX.3.26.C04.1.454.heavy.3.raw
agacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaagggactggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtgctacgagtactggtacttcgatctctggggccgtggcaccctgctgactgtctcctcagcctccaccaagggcccatcggtcttcccctggcgcctgctccaggagcacctccgagagcacagcggccctgggctgcctggtcaaggactacg

SEQ ID NO: 449193 - DNA, 521 bp, Homo sapiens
  misc_feature: HEFZJCU01DQPYB.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaacgggcccactcggtcctttccccctcggccta

SEQ ID NO: 449194 - DNA, 535 bp, Homo sapiens
  misc_feature: HEFZJCU01CZ6GB.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctgtgtttatggggccaggggagccctggtcaccg

SEQ ID NO: 449195 - DNA, 519 bp, Homo sapiens; identical to SEQ ID NO: 446650
  misc_feature: HEFZJCU01D6IUW.13.76.G10.1.454.heavy.3.raw

SEQ ID NO: 449196 - DNA, 512 bp, Homo sapiens; identical to SEQ ID NO: 446424
  misc_feature: HEFZJCU01B9ERH.4.39.D06.1.454.heavy.3.raw

SEQ ID NO: 449197 - DNA, 497 bp, Homo sapiens
  misc_feature: HEFZJCU01EDM61.40.35.D02.1.454.heavy.3.raw
tctagcgactcacgaccggtgctcgatttagcacacgatagttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagtacagcggccctgggctgcctggtcaaggactacttccagtcgctaga

SEQ ID NO: 449198 - DNA, 523 bp, Homo sapiens
  misc_feature: HEFZJCU01DJK3G.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcaggtggcgcagcctgggaggcctcggacaccgccatatattactgtgcgagtccggttatcgccgcagatcactactactactacggtctgggacgtcgtggggccaaggggacc

SEQ ID NO: 449199 - DNA, 507 bp, Homo sapiens
  misc_feature: HEFZJCU01C1F43.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttccccctggcgccctgctccaggagcacctctgggggcacagcggccctgggctgcctggtcaaggactacttcctcgtact

SEQ ID NO: 449200 - DNA, 522 bp, Homo sapiens
  misc_feature: HEFZJCU01C7E0M.4.33.C11.1.454.heavy.3.raw
agcactgtagcacgaccggtgctcgatttagagtgagctcgttgggtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgatttttggagtggatattataacccccactttgactactggggccagggaaccctggtcgccgtctcctcagcctccaccaagggcccatcggtcttccctggcgccctgctcca

SEQ ID NO: 449201 - DNA, 395 bp, Homo sapiens; identical to SEQ ID NO: 444579
  misc_feature: HEFZJCU01BYR8U.47.59.F04.1.454.heavy.3.raw

SEQ ID NO: 449202 - DNA, 410 bp, Homo sapiens; identical to SEQ ID NO: 444689
  misc_feature: HEFZJCU01A809O.52.87.H10.1.454.heavy.3.raw

SEQ ID NO: 449203 - DNA, 477 bp, Homo sapiens; identical to SEQ ID NO: 444659
  misc_feature: HEFZJCU01CJ0YJ.16.10.A10.1.454.heavy.3.raw

SEQ ID NO: 449204 - DNA, 497 bp, Homo sapiens; identical to SEQ ID NO: 446430
  misc_feature: HEFZJCU01DUTKO.51.78.H01.1.454.heavy.3.raw

SEQ ID NO: 449205 - DNA, 513 bp, Homo sapiens
  misc_feature: HEFZJCU01C3C40.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttccccctggcaccctcctccaagagcacctctgggggcacagcggccctggctgcctggtcaaggactacttccgagtgcgtct

SEQ ID NO: 449206 - DNA, 511 bp, Homo sapiens
  misc_feature: HEFZJCU01EQYMT.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggaaccct

SEQ ID NO: 449207 - DNA, 492 bp, Homo sapiens
  misc_feature: HEFZJCU01CJAUZ.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgagagcacagcggccctgggctgcctggtcaaggactacttccgtatctctcg

SEQ ID NO: 449208 - DNA, 502 bp, Homo sapiens
  misc_feature: HEFZJCU01EDYE8.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcggggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 449209 - DNA, 465 bp, Homo sapiens; identical to SEQ ID NO: 444805
  misc_feature: HEFZJCU01DC89P.19.10.A10.1.454.heavy.3.raw

SEQ ID NO: 449210 - DNA, 505 bp, Homo sapiens; identical to SEQ ID NO: 445664
  misc_feature: HEFZJCU01ATKG6.12.33.C11.1.454.heavy.3.raw

SEQ ID NO: 449211 - DNA, 384 bp, Homo sapiens; identical to SEQ ID NO: 444454
  misc_feature: HEFZJCU01A244O.11.61.F06.1.454.heavy.3.raw

SEQ ID NO: 449212 - DNA, 512 bp, Homo sapiens; identical to SEQ ID NO: 445279
  misc_feature: HEFZJCU01C2XB0.17.33.C11.1.454.heavy.3.raw

SEQ ID NO: 449213 - DNA, 507 bp, Homo sapiens; identical to SEQ ID NO: 446637
  misc_feature: HEFZJCU01BE7L7.16.34.D01.1.454.heavy.3.raw

SEQ ID NO: 449214 - DNA, 498 bp, Homo sapiens
  misc_feature: HEFZJCU01BCHKC.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggacgcacctc

SEQ ID NO: 449215 - DNA, 507 bp, Homo sapiens
  misc_feature: HEFZJCU01D0I89.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctcggcaccctcctccaagagcacctctgggggcacagcggccctgggctgcctggtcaaggactacttccgagtagtaca

SEQ ID NO: 449216 - DNA, 507 bp, Homo sapiens
  misc_feature: HEFZJCU01CLAD9.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttcg

SEQ ID NO: 449217 - DNA, 493 bp, Homo sapiens
  misc_feature: HEFZJCU01CI86O.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggcctggctgcctggtcaaggactac

SEQ ID NO: 449218 - DNA, 489 bp, Homo sapiens
  misc_feature: HEFZJCU01B8WBJ.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggcctgggctgcctggtcaaggactacttccagtcgctaga

SEQ ID NO: 449219 - DNA, 513 bp, Homo sapiens; identical to SEQ ID NO: 446452
  misc_feature: HEFZJCU01BTG2X.17.33.C11.1.454.heavy.3.raw

SEQ ID NO: 449220 - DNA, 513 bp, Homo sapiens
  misc_feature: HEFZJCU01CEUUP.4.67.G01.1.454.heavy.3.raw
  modified_base (487)..(487): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctattttaaaaggtgtccagtgtgaagtgcagctggtggagtctgggggaggcctggcacagccgggggggtccctgagactctcctgtgcagcctctggattcagtttttagaatgtctgccatgacctgggtccgccaggctcctgggaaggggctggagtggatctcagggattagtggcactgggcgattatacatattatacagactccgtgaagggccgcttcaccatctccagagacaattccaagaacacggtgtatctgcaaatgaacagcctgagagccgaaggcacggccacatattactgtgcgaaaagntctcgggctggttccgcggtccgggt

SEQ ID NO: 449221 - DNA, 482 bp, Homo sapiens; identical to SEQ ID NO: 446046
  misc_feature: HEFZJCU01AGJZA.10.35.D02.1.454.heavy.3.raw

SEQ ID NO: 449222 - DNA, 481 bp, Homo sapiens
  misc_feature: HEFZJCU01EATUC.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctggggcacagcggccctgggctgcctggtcaaggactacttccgtatctctcg

SEQ ID NO: 449223 - DNA, 469 bp, Homo sapiens; identical to SEQ ID NO: 447626
  misc_feature: HEFZJCU01EH9O2.15.34.D01.1.454.heavy.3.raw

SEQ ID NO: 449224 - DNA, 493 bp, Homo sapiens
  misc_feature: HEFZJCU01DCD1X.48.59.F04.1.454.heavy.3.raw
agtatacatacacgaccggtgctcgatttagtacacacacttagggattggggatgctttctgagagtcatggatctcatgtgcaagaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccaagggacaat

SEQ ID NO: 449225 - DNA, 396 bp, Homo sapiens; identical to SEQ ID NO: 444469
  misc_feature: HEFZJCU01AYGHA.47.46.E02.1.454.heavy.3.raw

SEQ ID NO: 449226 - DNA, 391 bp, Homo sapiens
  misc_feature: HEFZJCU01B5CPG.16.24.C02.1.454.heavy.3.raw
tgtactactccacgaccggtgctcgatttagtacagatcgttagggaaaggggctggagtgggtctcaagtattagtggtgttggtggtctcacatattacgcagactccgtgaagtgccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 449227 - DNA, 499 bp, Homo sapiens
  misc_feature: HEFZJCU01EPMOB.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaggactacttcctatgtatact

SEQ ID NO: 449228 - DNA, 493 bp, Homo sapiens
  misc_feature: HEFZJCU01B6CI4.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattctactta

SEQ ID NO: 449229 - DNA, 507 bp, Homo sapiens
  misc_feature: HEFZJCU01BXHD2.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattgggggcggaaggtatagcagtgg

SEQ ID NO: 449230 - DNA, 510 bp, Homo sapiens
  misc_feature: HEFZJCU01BSDW2.3.78.H01.1.454.heavy.3.raw
agacgcactccacgaccggtgctcgatttagtgtgagtagtttgggtttgggggctttctgagagtcatggacctcctgtgcaagaacatgaagcacctgtggtttttcctcctgctggtggcagctcccagatgggtcctgtcccaggtgcagctgcaggagtcgggcccaggactggtgaagccttcggagaccctgtccctcacctgcagtgtctctggctcctccatcagcagcggttactactggggctggatccggcagcccccagggaagggtctggagtggattgggagaatctatcatcttgggacgacctcctacaacccgtccctcaagagtcgagtcatcatatccctagacacgaccaagaaccagttctccctgaacctgagctctgtgaccgccgcagatacggccatgtattactgtgcgagggcatataactatggttattccgatgcttttgatgtctggggccaagggacagtggtcaccgtctcttcacg

SEQ ID NO: 449231 - DNA, 525 bp, Homo sapiens
  misc_feature: HEFZJCU01DX2UE.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttcca

SEQ ID NO: 449232 - DNA, 492 bp, Homo sapiens; identical to SEQ ID NO: 446787
  misc_feature: HEFZJCU01C1US3.4.7.A07.1.454.heavy.3.raw

SEQ ID NO: 449233 - DNA, 510 bp, Homo sapiens; identical to SEQ ID NO: 449039
  misc_feature: HEFZJCU01CDSRL.7.28.C06.1.454.heavy.3.raw

SEQ ID NO: 449234 - DNA, 489 bp, Homo sapiens
  misc_feature: HEFZJCU01DYAGB.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtgagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactacttccgtatctctcg

SEQ ID NO: 449235 - DNA, 548 bp, Homo sapiens
  misc_feature: HEFZJCU01A1YCA.52.5.A05.1.454.heavy.3.raw
cgcagtacgacacgaccggtgctcgatttagatagatagacagggggggggcaatttataaacccaaaaggacatggccatgcagcgggtagggacaatacagacagatatcagcctgaaatgtagcctcagggcacaggtgggcacgggcactgtccacctaagccaggggcagacccgagtgtccccgcagtagacctgagagcgctgggcccacagcctcccctcggtgccctgctacctcctcaggtcagccctgggcatcccgggtttcccagtcctggcggtaggttgggtgaagtctgtgtcactgtggtatttcgatttttggagtggttatttccttcctactactttgattattggggccagggaaccctggtctccttctcctcaatgctacgatctggacgtctggggccaagggaccacggtcaccgtctcctcagcctccaccaagggcccatcggtcttccccctggcaccctcctccaagagcacctctgggggcacagcggcctgggctgcctggtcaaggactactccta

SEQ ID NO: 449236 - DNA, 508 bp, Homo sapiens
  misc_feature: HEFZJCU01DMBNE.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcgggtccgggt

SEQ ID NO: 449237 - DNA, 443 bp, Homo sapiens
  misc_feature: HEFZJCU01EMTQ4.5.9.A09.1.454.heavy.3.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgcccctcggtcactctgttcccaccctcctccgtgtctgat

SEQ ID NO: 449238 - DNA, 510 bp, Homo sapiens; identical to SEQ ID NO: 445542
  misc_feature: HEFZJCU01C0A2C.16.21.B10.1.454.heavy.3.raw

SEQ ID NO: 449239 - DNA, 482 bp, Homo sapiens; identical to SEQ ID NO: 446459
  misc_feature: HEFZJCU01B6MGW.10.35.D02.1.454.heavy.3.raw

SEQ ID NO: 449240 - DNA, 396 bp, Homo sapiens; identical to SEQ ID NO: 444469
  misc_feature: HEFZJCU01B3VAE.47.46.E02.1.454.heavy.3.raw

SEQ ID NO: 449241 - DNA, 391 bp, Homo sapiens; identical to SEQ ID NO: 447368
  misc_feature: HEFZJCU01DP9DK.13.77.G11.1.454.heavy.3.raw

SEQ ID NO: 449242 - DNA, 312 bp, Homo sapiens; identical to SEQ ID NO: 444415
  misc_feature: HEFZJCU01ARRUI.7.10.A10.1.454.heavy.3.raw

SEQ ID NO: 449243 - DNA, 473 bp, Homo sapiens
  misc_feature: HEFZJCU01EPZFX.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctacgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagagcctc

SEQ ID NO: 449244 - DNA, 484 bp, Homo sapiens; identical to SEQ ID NO: 445311
  misc_feature: HEFZJCU01ASAHY.11.23.C01.1.454.heavy.3.raw

SEQ ID NO: 449245 - DNA, 482 bp, Homo sapiens; identical to SEQ ID NO: 444904
  misc_feature: HEFZJCU01BAZV3.47.59.F04.1.454.heavy.3.raw

SEQ ID NO: 449246 - DNA, 538 bp, Homo sapiens
  misc_feature: HEFZJCU01BL1WJ.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccggaaccgtggtcaccgtctcctcagcctccaccaacggcccatcggtcttccccctcggccaccctccctccaagacg

SEQ ID NO: 449247 - DNA, 508 bp, Homo sapiens; identical to SEQ ID NO: 445594
  misc_feature: HEFZJCU01BOCLD.17.25.C03.1.454.heavy.3.raw

SEQ ID NO: 449248 - DNA, 503 bp, Homo sapiens
  misc_feature: HEFZJCU01AE4NC.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgactttttggagtt

SEQ ID NO: 449249 - DNA, 460 bp, Homo sapiens; identical to SEQ ID NO: 444688
  misc_feature: HEFZJCU01D6J0V.53.12.B01.1.454.heavy.3.raw

SEQ ID NO: 449250 - DNA, 516 bp, Homo sapiens
  misc_feature: HEFZJCU01B5LBU.52.37.D04.1.454.heavy.3.raw
cgcagtacgacacgaccggtgctcgatttagtagcatactgttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctaccggctgctacttcgatctctgggccgtggcaccctggtcactgtcttctcagcctccaccaagggcccatcggtcttccccctggcaccctcctccaagagcacctctgggggcacagcggccctgggctgcctggtcaaggactacttcctatacg

SEQ ID NO: 449251 - DNA, 524 bp, Homo sapiens
  misc_feature: HEFZJCU01DJB8C.10.79.H02.1.454.heavy.3.raw
catagtagtgcacgaccggtgctcgatttagtgtcacacgaagggaaaggggtctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgacaatgaaccaccctgcgagccgaggacgacggccgtatattactgtgcgagaactaaccgttcgcctggtttacttaccttg

SEQ ID NO: 449252 - DNA, 480 bp, Homo sapiens
  misc_feature: HEFZJCU01CJBQE.11.23.C01.1.454.heavy.3.raw
  modified_base (407)..(407): a, c, t, g, unknown or other
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgagacacgggcgtgtatttttgtgccagagaagagggatattgctctgatggtgtctgctattacgtctacggtttggacgtctggggccaagggaccacggtcatcgtctcctcagcctccaccaagggcccatcgtcttcccctggcnccctcctccaagagcacctctgggggcacagcggccctggctgcctggtcaaggactacttccgtatctctcg

SEQ ID NO: 449253 - DNA, 527 bp, Homo sapiens
  misc_feature: HEFZJCU01EHXR0.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactactc

SEQ ID NO: 449254 - DNA, 466 bp, Homo sapiens
  misc_feature: HEFZJCU01E11QF.48.7.A07.1.454.heavy.3.raw
agtatacatacacgaccggtgctcgatttagcacgtgtcgcaggggcagggtgtacacctgtggttctcggggctgtcctttggttttggagatggttttctcgatgggggctgggatggctcaacgctgacgatggtcaaacaaaatattcacagcaattccagggcagactctcccttaccagggacacttccgcgaacacaggctacatgtttttgagcagactgacatctaaagacacggctatttactactgtgcgagaggcggattttgtcggcgtggtgattgttacagtcagaatcgtcgattgtggttcgacccctggggccagggaaccctgctctccgtctcctcagcttccaccaagggcccatcggtcttccccctggcgccctgctccaggagcacctctgggggcacagcgccctgggctgcctggtcaaggactacttcctatgtatact

SEQ ID NO: 449255 - DNA, 518 bp, Homo sapiens
  misc_feature: HEFZJCU01BRBPN.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattc

SEQ ID NO: 449256 - DNA, 482 bp, Homo sapiens; identical to SEQ ID NO: 444503
  misc_feature: HEFZJCU01EDP4B.7.10.A10.1.454.heavy.3.raw

SEQ ID NO: 449257 - DNA, 482 bp, Homo sapiens
  misc_feature: HEFZJCU01BZ3VS.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccagagcacctccgagagcacagcggccctgggctgcctggtcaaggactacttcccactactatg

SEQ ID NO: 449258 - DNA, 488 bp, Homo sapiens
  misc_feature: HEFZJCU01BRLW3.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaaggactacttcctacgtcgtat

SEQ ID NO: 449259 - DNA, 495 bp, Homo sapiens
  misc_feature: HEFZJCU01CK0RI.13.85.H08.1.454.heavy.3.raw
tcacgtactacacgaccggtgctcgatttagtatcactcagtcgcggggagcagcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttggggt

SEQ ID NO: 449260 - DNA, 521 bp, Homo sapiens; identical to SEQ ID NO: 446385
  misc_feature: HEFZJCU01BNC13.9.63.F08.1.454.heavy.3.raw

SEQ ID NO: 449261 - DNA, 521 bp, Homo sapiens; identical to SEQ ID NO: 445351
  misc_feature: HEFZJCU01AM03R.19.86.H09.1.454.heavy.3.raw

SEQ ID NO: 449262 - DNA, 532 bp, Homo sapiens
  misc_feature: HEFZJCU01E089U.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaacggg

SEQ ID NO: 449263 - DNA, 374 bp, Homo sapiens; identical to SEQ ID NO: 444640
  misc_feature: HEFZJCU01AGOHR.7.37.D04.1.454.heavy.3.raw

SEQ ID NO: 449264 - DNA, 490 bp, Homo sapiens; identical to SEQ ID NO: 445139
  misc_feature: HEFZJCU01DRBUF.12.75.G09.1.454.heavy.3.raw

SEQ ID NO: 449265 - DNA, 515 bp, Homo sapiens
  misc_feature: HEFZJCU01CTPQU.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacttctggggccagggtaaccccg

SEQ ID NO: 449266 - DNA, 515 bp, Homo sapiens
  misc_feature: HEFZJCU01EOL53.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagttggttactgttggactactttgactacgtggggccaggggaaccctggtcc

SEQ ID NO: 449267 - DNA, 516 bp, Homo sapiens
  misc_feature: HEFZJCU01CRLZQ.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggccccatcggtcttccccctggcgccctgctccaggagcaccc

SEQ ID NO: 449268 - DNA, 531 bp, Homo sapiens; identical to SEQ ID NO: 446857
  misc_feature: HEFZJCU01D5TPE.7.78.H01.1.454.heavy.3.raw

SEQ ID NO: 449269 - DNA, 511 bp, Homo sapiens
  misc_feature: HEFZJCU01AJY03.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcacagcggcccctggg

SEQ ID NO: 449270 - DNA, 509 bp, Homo sapiens
  misc_feature: HEFZJCU01AIWJB.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgacaaatgaacagcctaggaagacgcggacacagccatgtaatttattgtactattaggactactattacc

SEQ ID NO: 449271 - DNA, 526 bp, Homo sapiens
  misc_feature: HEFZJCU01APES1.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcttttacacctcccttgacttctggggccatggaacccggtcg

SEQ ID NO: 449272 - DNA, 527 bp, Homo sapiens
  misc_feature: HEFZJCU01BJZDC.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtcaagggccgattcaccgtctccagagacaacaccaagaacacactatatctgcagattgacagtctgagacccgaggacacggctgtgtattactgtgcaaggcagttcgtggaaacagttatggttgggggagtgggttttttttcgtactacgggatggacgtctggggccgagggaccgcggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 449273 - DNA, 480 bp, Homo sapiens
  misc_feature: HEFZJCU01CT4MI.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggccatcggtcttcccctggcaccctcctccaagagcacctctgggggcacagcggccctgggctgcctggtcaaggactacttcctagagacacg

SEQ ID NO: 449274 - DNA, 503 bp, Homo sapiens
  misc_feature: HEFZJCU01DMWZ7.52.86.H09.1.454.heavy.3.raw
cgcagtacgacacgaccggtgctcgatttagtgctatagacttgggtttgggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcagccctacgg

SEQ ID NO: 449275 - DNA, 505 bp, Homo sapiens
  misc_feature: HEFZJCU01C2NST.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggccc

SEQ ID NO: 449276 - DNA, 507 bp, Homo sapiens
  misc_feature: HEFZJCU01A8GJI.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcac

SEQ ID NO: 449277 - DNA, 481 bp, Homo sapiens
  misc_feature: HEFZJCU01DUQ6D.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcaccctccgagagcacagcggccctgggctgcctggtcaaggactacttcccacgagagta

SEQ ID NO: 449278 - DNA, 479 bp, Homo sapiens; identical to SEQ ID NO: 447128
  misc_feature: HEFZJCU01ERAQG.4.37.D04.1.454.heavy.3.raw

SEQ ID NO: 449279 - DNA, 395 bp, Homo sapiens
  misc_feature: HEFZJCU01EHJF9.21.60.F05.1.454.heavy.3.raw
tcgtcgctcgcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctgaaaccgaggacacggccgtctattactgtgctagacctagtggctcgtccgactggttgaagttcgacccctggggccgggaaccctggtcaccgtctcctcggcctccaccaagggcccatcggtcttccccctggcgccctgctccaggagcacctccgagagcacagcggccctgggctgcctggtcaaggactacttcccgagcgacga

SEQ ID NO: 449280 - DNA, 531 bp, Homo sapiens; identical to SEQ ID NO: 446857
  misc_feature: HEFZJCU01DG2ER.7.78.H01.1.454.heavy.3.raw

SEQ ID NO: 449281 - DNA, 493 bp, Homo sapiens
  misc_feature: HEFZJCU01B1L83.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactacta

SEQ ID NO: 449282 - DNA, 408 bp, Homo sapiens; identical to SEQ ID NO: 445853
  misc_feature: HEFZJCU01DK99B.49.43.D10.1.454.heavy.3.raw

SEQ ID NO: 449283 - DNA, 387 bp, Homo sapiens; identical to SEQ ID NO: 444818
  misc_feature: HEFZJCU01CNUZ6.11.79.H02.1.454.heavy.3.raw

SEQ ID NO: 449284 - DNA, 385 bp, Homo sapiens; identical to SEQ ID NO: 445158
  misc_feature: HEFZJCU01CZSHK.27.46.E02.1.454.heavy.3.raw

SEQ ID NO: 449285 - DNA, 518 bp, Homo sapiens
  misc_feature: HEFZJCU01AL5YD.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagcggccctgggctgcctgtcaaggctactcctacg

SEQ ID NO: 449286 - DNA, 521 bp, Homo sapiens
  misc_feature: HEFZJCU01C4IGA.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggcaccctcctccaagagcacctctggggggcacgac

SEQ ID NO: 449287 - DNA, 516 bp, Homo sapiens
  misc_feature: HEFZJCU01EO4NM.13.55.E11.1.454.heavy.3.raw
tcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactatattttttgtactttctc

SEQ ID NO: 449288 - DNA, 505 bp, Homo sapiens; identical to SEQ ID NO: 447076
  misc_feature: HEFZJCU01C5MZ0.10.38.D05.1.454.heavy.3.raw

SEQ ID NO: 449289 - DNA, 535 bp, Homo sapiens
  misc_feature: HEFZJCU01EOHK7.52.12.B01.1.454.heavy.3.raw
cgcagtacgacacgaccggtgctcgatttagtagtgtagattccgcgggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtattggatcggggaaaattactactccggtatggacgtctggggccaagggaccacggtcaccgtctcctcagcctccaccaac

SEQ ID NO: 449290 - DNA, 496 bp, Homo sapiens; identical to SEQ ID NO: 444697
  misc_feature: HEFZJCU01C1CV6.16.37.D04.1.454.heavy.3.raw

SEQ ID NO: 449291 - DNA, 518 bp, Homo sapiens; identical to SEQ ID NO: 444718
  misc_feature: HEFZJCU01EV65G.9.34.D01.1.454.heavy.3.raw

SEQ ID NO: 449292 - DNA, 506 bp, Homo sapiens
  misc_feature: HEFZJCU01EOUWO.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaaagacacggctgtgtattactgtgtgtctctgacgcctcggccgacttggctttc

SEQ ID NO: 449293 - DNA, 505 bp, Homo sapiens
  misc_feature: HEFZJCU01EAM37.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 449294 - DNA, 502 bp, Homo sapiens
  misc_feature: HEFZJCU01EBFTP.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggctttttgatgcctttgatatgtggggccgaagggacaatggtcaccgtctt

SEQ ID NO: 449295 - DNA, 482 bp, Homo sapiens; identical to SEQ ID NO: 448987
  misc_feature: HEFZJCU01C0X2A.10.35.D02.1.454.heavy.3.raw

SEQ ID NO: 449296 - DNA, 449 bp, Homo sapiens
  misc_feature: HEFZJCU01BZ6K2.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcgccctgggctgcctggtcaaggactacttccagacgtatca

SEQ ID NO: 449297 - DNA, 510 bp, Homo sapiens
  misc_feature: HEFZJCU01BWL6N.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagacgtcccacgatccggtgagcctacggcagcggcctttgacttcgtggggccagggacg

SEQ ID NO: 449298 - DNA, 543 bp, Homo sapiens
  misc_feature: HEFZJCU01AOPBJ.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcgggggagtttggttcctggggccaggggaaccctgggtcc

SEQ ID NO: 449299 - DNA, 503 bp, Homo sapiens
  misc_feature: HEFZJCU01DS3OL.53.54.E10.1.454.heavy.3.raw
cgcgtatacacacgaccggtgctcgatttagatcgtagcagaacacacaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaacatggtgtttctgcaaatgaacagcctgagagttgaagacacggctgtgtattactgtgcgaaacggaatgagtgggaactagggg

SEQ ID NO: 449300 - DNA, 498 bp, Homo sapiens
  misc_feature: HEFZJCU01DQOTA.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaaggac

SEQ ID NO: 449301 - DNA, 505 bp, Homo sapiens
  misc_feature: HEFZJCU01EF9OH.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaaggcccatcggtcttcccctggcgccctgctccaggagcacctccgagagcacagcggccctc

SEQ ID NO: 449302 - DNA, 530 bp, Homo sapiens; identical to SEQ ID NO: 448777
  misc_feature: HEFZJCU01A4U3D.18.33.C11.1.454.heavy.3.raw

SEQ ID NO: 449303 - DNA, 535 bp, Homo sapiens
  misc_feature: HEFZJCU01CJUGU.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaacctggtcaccgtctcctcagcctccaccaagggccc

SEQ ID NO: 449304 - DNA, 533 bp, Homo sapiens
  misc_feature: HEFZJCU01AMP0O.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttccccctggcaccctcctccaagagcacctctgggggcacagcggccctgggctgcctgtcaaggactacttccgtatctctcg

SEQ ID NO: 449305 - DNA, 511 bp, Homo sapiens
  misc_feature: HEFZJCU01DAJAM.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactaggggccg

SEQ ID NO: 449306 - DNA, 523 bp, Homo sapiens
  misc_feature: HEFZJCU01A5DMG.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggacccg

SEQ ID NO: 449307 - DNA, 465 bp, Homo sapiens; identical to SEQ ID NO: 444805
  misc_feature: HEFZJCU01DO1JD.19.10.A10.1.454.heavy.3.raw

SEQ ID NO: 449308 - DNA, 517 bp, Homo sapiens; identical to SEQ ID NO: 446891
  misc_feature: HEFZJCU01BXZY4.17.33.C11.1.454.heavy.3.raw

SEQ ID NO: 449309 - DNA, 507 bp, Homo sapiens
  misc_feature: HEFZJCU01DGLQP.26.73.G07.1.454.heavy.3.raw
agactatactcacgaccggtgctcgatttagctctacgctcaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactgggtgcgacaggcccctggacaaggacttgagtggttgggatggatcaacaccaacactgggcacccgacgtatctccaggacctcacaggacggcttgtcttttccgtggacacttctgtcagcacggcatatctgcagatcagcagtctaaagcctgaggacactgccgtgtattattgtacgagagaacgttatgcctgtagtggtggtagttgctactttgactactggggccagggacg

SEQ ID NO: 449310 - DNA, 543 bp, Homo sapiens
  misc_feature: HEFZJCU01CGVKE.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctgggggccaggggaaccctggtccg

SEQ ID NO: 449311 - DNA, 315 bp, Homo sapiens; identical to SEQ ID NO: 444422
  misc_feature: HEFZJCU01BQZY2.47.84.H07.1.454.heavy.3.raw

SEQ ID NO: 449312 - DNA, 501 bp, Homo sapiens
  misc_feature: HEFZJCU01EORCS.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccaacgacacggccatatattactgtgcgaaagcaccggcagttagtcaccatactactttgactac

SEQ ID NO: 449313 - DNA, 523 bp, Homo sapiens
  misc_feature: HEFZJCU01A3W0E.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccaggggaagctttggtcaccgtctcctcagcct

SEQ ID NO: 449314 - DNA, 323 bp, Homo sapiens; identical to SEQ ID NO: 444416
  misc_feature: HEFZJCU01C6GEM.47.38.D05.1.454.heavy.3.raw

SEQ ID NO: 449315 - DNA, 462 bp, Homo sapiens; identical to SEQ ID NO: 444770
  misc_feature: HEFZJCU01CY0IX.40.23.C01.1.454.heavy.3.raw

SEQ ID NO: 449316 - DNA, 479 bp, Homo sapiens; identical to SEQ ID NO: 447128
  misc_feature: HEFZJCU01C3TTP.4.37.D04.1.454.heavy.3.raw

SEQ ID NO: 449317 - DNA, 477 bp, Homo sapiens
  misc_feature: HEFZJCU01BG3ZZ.12.81.H04.1.454.heavy.3.raw
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttccccctggcgccctgctccaggagcacctccgagagcacagcggccctgggctgcctggtcaaggactacttcctacgtcgtat

SEQ ID NO: 449318 - DNA, 506 bp, Homo sapiens
  misc_feature: HEFZJCU01CNCV9.16.38.D05.1.454.heavy.3.raw
tgtactactccacgaccggtgctcgatttagtatctgatagttgggtttgggctgggagacgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactacg

SEQ ID NO: 449319 - DNA, 529 bp, Homo sapiens
  misc_feature: HEFZJCU01AESKW.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagcgtggagtttccttaacgtgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagaatgattcaaaagtacactgtatctggaaatgaacagcctgagaatcgacgacacagccgtttattactgcagagagggcactatgtccctggggccaggggaaccctgggtcaccgtctcctcag

SEQ ID NO: 449320 - DNA, 520 bp, Homo sapiens
  misc_feature: HEFZJCU01EYEQR.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttg

SEQ ID NO: 449321 - DNA, 503 bp, Homo sapiens; identical to SEQ ID NO: 445162
  misc_feature: HEFZJCU01CTVQ3.21.70.G04.1.454.heavy.3.raw

SEQ ID NO: 449322 - DNA, 490 bp, Homo sapiens
  misc_feature: HEFZJCU01D7217.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaaggggcccatcggtcttcccctggcgccctgctccaggagcacctctgggggcacagcggccctgggctgcctggtcaaggactacttcctatgtatct

SEQ ID NO: 449323 - DNA, 396 bp, Homo sapiens; identical to SEQ ID NO: 444469
  misc_feature: HEFZJCU01BMMUA.47.46.E02.1.454.heavy.3.raw

SEQ ID NO: 449324 - DNA, 484 bp, Homo sapiens
  misc_feature: HEFZJCU01CRT2A.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactctggggccagggaaccctggtcatcgtctcctcagcctccaccaagggcccatcggtcttcccctggcgcctgctcagagcacctccgagagcgacagcggccgtcgggcgtgcctggtcaaggacgtacttcctacgt

SEQ ID NO: 449325 - DNA, 496 bp, Homo sapiens
  misc_feature: HEFZJCU01BIA66.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtattgcaaatgaacagtctgagagtcgaggacacggccatatattactgtgcgaagcgggaattggtggcggtgactgctattgactactggggccagggaaccctgggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 449326 - DNA, 519 bp, Homo sapiens
  misc_feature: HEFZJCU01D61V1.4.25.C03.1.454.heavy.3.raw
agcactgtagcacgaccggtgctcgatttagtagtgtagatttgggtttgggctgagcgtgggttttccgtcgttagctcttttaagaggtgtccagtgtcacgtgcgcctggtggagtctggggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgcgagggcggttacccctctggttccttcgacagttatggtatgggacgtcgtgggggccgtagggacgtacggtcaccgtcctcctcagcctccaccaagggcccatccggtcttccccc

SEQ ID NO: 449327 - DNA, 527 bp, Homo sapiens; identical to SEQ ID NO: 446218
  misc_feature: HEFZJCU01DL7LK.9.33.C11.1.454.heavy.3.raw

SEQ ID NO: 449328 - DNA, 539 bp, Homo sapiens
  misc_feature: HEFZJCU01CTNBD.48.27.C05.1.454.heavy.3.raw
agtatacatacacgaccggtgctcgatttagacgcgatcgaagggtttggggatactttctgagagtcctggacctcctgtgcaagaacatgaaacacctgtggttcttcctcctcctggtggcaactcccagatgggtcctgtcccaggtgcagctgcaggagtcgggcccagggctggtgaagccttcggagaccctgtccctcacctgcagtgtctctgatgcctccgtcagcaacgaaaattattgttggacctggatccggcaggccccagggaaggcgccggagtggattggatataccggttctcgtcctgcgtacaccaatgacaatccccccctcaggagccgaatctccatatcactggacacgtccaagaaccggttctccctgaccctgaggtctgtgaccgctgcggacacggccgtctattactgtgcgaggattccccttggacacccatttggttactttgactattggggccaggggagccctggtcaccgtctcctcagcctccaccaagggcccatcggt

SEQ ID NO: 449329 - DNA, 442 bp, Homo sapiens; identical to SEQ ID NO: 446170
  misc_feature: HEFZJCU01C53N5.10.11.A11.1.454.heavy.3.raw

SEQ ID NO: 449330 - DNA, 513 bp, Homo sapiens
  misc_feature: HEFZJCU01CJIVW.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagtctccctgaagctgagctctgtgaccgccgcggacacggctgtgtattactgtgcgagaggcttggtagcagtggctcccgggggctttgactactggggccagggaaccctggtcaccgtctcctcagcctccaccaaggccc

SEQ ID NO: 449331 - DNA, 501 bp, Homo sapiens; identical to SEQ ID NO: 445341
  misc_feature: HEFZJCU01ESUC8.48.34.D01.1.454.heavy.3.raw

SEQ ID NO: 449332 - DNA, 512 bp, Homo sapiens; identical to SEQ ID NO: 447037
  misc_feature: HEFZJCU01BX3R2.17.33.C11.1.454.heavy.3.raw

SEQ ID NO: 449333 - DNA, 487 bp, Homo sapiens
  misc_feature: HEFZJCU01CVDH6.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctgcgccctgctccaggagcacctccgagagcacagcggccctgggctgcctggtcaaggactacttccctacagtgct

SEQ ID NO: 449334 - DNA, 510 bp, Homo sapiens
  misc_feature: HEFZJCU01BU6MJ.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcaccctggtcactgtctcctcggcttccaccaagggccatcggtcttcccctggcgcctgctccaggagcacctctggggcacagcggcccg

SEQ ID NO: 449335 - DNA, 383 bp, Homo sapiens; identical to SEQ ID NO: 444673
  misc_feature: HEFZJCU01CAALJ.11.61.F06.1.454.heavy.3.raw

SEQ ID NO: 449336 - DNA, 512 bp, Homo sapiens
  misc_feature: HEFZJCU01CAANZ.48.87.H10.1.454.heavy.3.raw
agtatacatacacgaccggtgctcgatttagcagtactgcgttgggtttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtggggccaagggacaatggtcaccgtctcttcagtcctccaccacgggacccg

SEQ ID NO: 449337 - DNA, 503 bp, Homo sapiens
  misc_feature: HEFZJCU01DMLSO.40.31.C09.1.454.heavy.3.raw
tctagcgactcacgaccggtgctcgatttagacgtctcatcaaggaaggaagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggagttgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgtcttttgatgcttgatatgtgggcgaaggacaagtgtctaccg

SEQ ID NO: 449338 - DNA, 396 bp, Homo sapiens; identical to SEQ ID NO: 444469
  misc_feature: HEFZJCU01DI2O4.47.46.E02.1.454.heavy.3.raw

SEQ ID NO: 449339 - DNA, 518 bp, Homo sapiens; identical to SEQ ID NO: 446943
  misc_feature: HEFZJCU01BWN7B.7.78.H01.1.454.heavy.3.raw

SEQ ID NO: 449340 - DNA, 530 bp, Homo sapiens
  misc_feature: HEFZJCU01B6IHK.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtgggggccaggggaaccctgggtcaccgtctcctcagcctccaccg

SEQ ID NO: 449341 - DNA, 430 bp, Homo sapiens
  misc_feature: HEFZJCU01B5539.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatgggatcgaccctaacagcggtggcacaaagtatgcacagaagtttcagggcagggtcaccatgaccagggacacgtccatcagcacgtccatcagcacagcctacatgga

SEQ ID NO: 449342 - DNA, 542 bp, Homo sapiens
  misc_feature: HEFZJCU01EUZI0.40.16.B05.1.454.heavy.3.raw
tctagcgactcacgaccggtgctcgatttagagctcacgtaagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctccctcgagagtcgagtcaccatttcactagacacgtccacaaatcagttgtccctgaggctgagctctgtgaccgccgcggacacgggcgtatattactgtgcgaggaggggggccgggggaaactcctagtggctcctttgactacgtggggccagggaaccctggtccaccgtctcctcacgcctccaccaagggccccagtccggtcttcccccgtggccgccctggcctccaggacgctacccg

SEQ ID NO: 449343 - DNA, 490 bp, Homo sapiens
  misc_feature: HEFZJCU01EC39L.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 449344 - DNA, 500 bp, Homo sapiens; identical to SEQ ID NO: 447017
  misc_feature: HEFZJCU01CTPUF.13.12.B01.1.454.heavy.3.raw

SEQ ID NO: 449345 - DNA, 518 bp, Homo sapiens; identical to SEQ ID NO: 444718
  misc_feature: HEFZJCU01CWMUE.9.34.D01.1.454.heavy.3.raw

SEQ ID NO: 449346 - DNA, 504 bp, Homo sapiens
  misc_feature: HEFZJCU01C8YO9.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagccaatagtggtgccacaaagacagcacagaagtttcagggcagggtcaccatgaccagggagacgtccgtcaggacagcctatatggaggtgaccagcctgagccctgacgacacggccatatattttctgtgcgcgaggaatttcgacttctggaataattacttgggttggaaactacctt

SEQ ID NO: 449347 - DNA, 500 bp, Homo sapiens
  misc_feature: HEFZJCU01DCDYH.49.82.H05.1.454.heavy.3.raw
  modified_base (479)..(479): a, c, t, g, unknown or other
agtcgagagacacgaccggtgctcgatttagtcgagctctctcgcgggggaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaacngcggctggtactttgactacg

SEQ ID NO: 449348 - DNA, 496 bp, Homo sapiens; identical to SEQ ID NO: 445798
  misc_feature: HEFZJCU01C85DM.12.55.E11.1.454.heavy.3.raw

SEQ ID NO: 449349 - DNA, 327 bp, Homo sapiens; identical to SEQ ID NO: 444439
  misc_feature: HEFZJCU01D9027.40.20.B09.1.454.heavy.3.raw

SEQ ID NO: 449350 - DNA, 520 bp, Homo sapiens
  misc_feature: HEFZJCU01D6CHZ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctaccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 449351 - DNA, 483 bp, Homo sapiens
  misc_feature: HEFZJCU01ED7YL.19.71.G05.1.454.heavy.3.raw
tactctcgtgcacgaccggtgctcgatttagtgtcgtcgcaagagagagggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctt

SEQ ID NO: 449352 - DNA, 501 bp, Homo sapiens
  misc_feature: HEFZJCU01D2GB3.48.49.E05.1.454.heavy.3.raw
agtatacatacacgaccggtgctcgatttagagcgactagcaacacacaaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgggggggtccctgagactctcctgtgcagcctctggactcacctttagtacctattggatgacctgggtccgccaatctccagggagggggctggagtgggtggccaacataaagggagatggaagtaagacatactatgcggattctgtgaagggccgattcaccatctccagagacaacgccaaggagtcactgtatctgcagatgaacagcctgagagccgaggacgcggctgtgtattactgtgcgagagatgtgaatccctttg

SEQ ID NO: 449353 - DNA, 521 bp, Homo sapiens
  misc_feature: HEFZJCU01DEQXT.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacaacgggcgtgtattttgtgtgaaagatacgaagtctatgatacccaatttgggaggggcctttcat

SEQ ID NO: 449354 - DNA, 520 bp, Homo sapiens
  misc_feature: HEFZJCU01AXNO3.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctcgtgggggcacagcggcccgtgggctgcctggtcaaggactacttccagacgtatca

SEQ ID NO: 449355 - DNA, 321 bp, Homo sapiens
  misc_feature: HEFZJCU01CD6FN.13.66.F11.1.454.heavy.3.raw
tcacgtactacacgaccggtgctcgatttagtcacgcgagaagggcagattcgaccatctcccagagatgattcaaggaacacagtgtttctgcaaatgaacagcctgactgccggggacactgccgtgtattactgtgccagcagcagtacctggccactatattttttgacttctggggccaggggaaccctggccaccggtctcctcagcttccaccaagggcccatcggtcttccccctggcgccctgctccaggagcacctctgggggcacagcggccctgggctgcctggtcaaggactacttcctagtacgtga

SEQ ID NO: 449356 - DNA, 483 bp, Homo sapiens; identical to SEQ ID NO: 444932
  misc_feature: HEFZJCU01EV1DU.7.10.A10.1.454.heavy.3.raw

SEQ ID NO: 449357 - DNA, 522 bp, Homo sapiens
  misc_feature: HEFZJCU01E0M3S.48.37.D04.1.454.heavy.3.raw
agtatacatacacgaccggtgctcgatttagtagcatactgttgggtttggggggtttgggctcaactctcttgtccgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacagggctggttcgacccctggggccagggaaccctagtcaccgtctcctcagcctccaccaagggcccatcggtcttcccctggcaccctcctccaagagcacctctgggggcacagcggccctgggctgcctggtcaaggactacttcctatgtatact

SEQ ID NO: 449358 - DNA, 534 bp, Homo sapiens
  misc_feature: HEFZJCU01C8DCM.12.40.D07.1.454.heavy.3.raw
atacgacgtacacgaccggtgctcgatttagtgatagagcgtaacaacagagggctcaccatggagttttgggctgagcggtcggtttcgtcgtaggcgtctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttttatctgcaaatgacagcctgagaccagacgacacggctgtctattattgcgcgagagagacacacgaacctactggccaatactatgggggcttggttctgggggccaggggaccctggtcatcgtctccccagcctccaccaagggcccatcggtcttccccctggcgcccgtc

SEQ ID NO: 449359 - DNA, 514 bp, Homo sapiens
  misc_feature: HEFZJCU01EYRPZ.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgataaccggaggggttgt

SEQ ID NO: 449360 - DNA, 537 bp, Homo sapiens; identical to SEQ ID NO: 445697
  misc_feature: HEFZJCU01AXN56.14.57.F02.1.454.heavy.3.raw

SEQ ID NO: 449361 - DNA, 400 bp, Homo sapiens; identical to SEQ ID NO: 444452
  misc_feature: HEFZJCU01BA3CX.47.24.C02.1.454.heavy.3.raw

SEQ ID NO: 449362 - DNA, 495 bp, Homo sapiens; identical to SEQ ID NO: 449052
  misc_feature: HEFZJCU01EW09G.16.37.D04.1.454.heavy.3.raw

SEQ ID NO: 449363 - DNA, 483 bp, Homo sapiens
  misc_feature: HEFZJCU01EZ3WC.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctgcgccctgctccaggagcacctccgagagcacagcggccctgggctgcctggtcaaggactactttcccactactatg

SEQ ID NO: 449364 - DNA, 507 bp, Homo sapiens; identical to SEQ ID NO: 448371
  misc_feature: HEFZJCU01A7LD4.3.81.H04.1.454.heavy.3.raw

SEQ ID NO: 449365 - DNA, 535 bp, Homo sapiens
  misc_feature: HEFZJCU01A972V.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaaacctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggccc

SEQ ID NO: 449366 - DNA, 480 bp, Homo sapiens; identical to SEQ ID NO: 446171
  misc_feature: HEFZJCU01BAEMS.22.36.D03.1.454.heavy.3.raw

SEQ ID NO: 449367 - DNA, 506 bp, Homo sapiens; identical to SEQ ID NO: 446520
  misc_feature: HEFZJCU01CK9V3.10.38.D05.1.454.heavy.3.raw

SEQ ID NO: 449368 - DNA, 516 bp, Homo sapiens; identical to SEQ ID NO: 445176
  misc_feature: HEFZJCU01B2B7X.14.66.F11.1.454.heavy.3.raw

SEQ ID NO: 449369 - DNA, 423 bp, Homo sapiens; identical to SEQ ID NO: 446550
  misc_feature: HEFZJCU01D05JN.11.22.B11.1.454.heavy.3.raw

SEQ ID NO: 449370 - DNA, 527 bp, Homo sapiens
  misc_feature: HEFZJCU01CUG66.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagccggcccgtgggc

SEQ ID NO: 449371 - DNA, 412 bp, Homo sapiens
  misc_feature: HEFZJCU01AQ0ZZ.13.30.C08.1.454.heavy.3.raw
tcacgtactacacgaccggtgctcgatttagtctgacgtcaaagggaaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggggcacagcggccctgggctgcctggtcaaggactacttcctagtacgtga

SEQ ID NO: 449372 - DNA, 411 bp, Homo sapiens
  misc_feature: HEFZJCU01D5NXT.52.61.F06.1.454.heavy.3.raw
cgcagtacgacacgaccggtgctcgatttagctacgctctaagggaaaggggctggagttggtcgcgtcaattagttatagtggtaataacaagaattatgaagagtccgtgaagggccggttcaccatctccagagacaattccaagaacactctgtctctacaaatgaacagcctgagagccgaggacacggccgtatattactgtgcgtcgccaagcctattagcttggttcggggagttactgagagatccttcctttgatatctggggccaagggacaatggtcgtcgtctcttcagcctccaccaagggcccatcggtcttccccctggcaccctcctccaagagcacctctgggggcacagcggccctgggctgcctggtcaaggactacttcctatacgatcg

SEQ ID NO: 449373 - DNA, 519 bp, Homo sapiens
  misc_feature: HEFZJCU01ELEXI.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactacttgtgggctctgtgaagggccgattcaccatctccagagacaacgccaagaagtcactgtatctgcaaatgaacgatgtgagagtcgaggacacggctgtatatttctgtgcgaggggagccggctatggttcgacctctggggccaggggaaccctggtaccg

SEQ ID NO: 449374 - DNA, 511 bp, Homo sapiens
  misc_feature: HEFZJCU01CCBAP.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgatttttac

SEQ ID NO: 449375 - DNA, 537 bp, Homo sapiens
  misc_feature: HEFZJCU01CKYDP.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaagtgaggtctgttaccgccgcggacacggctgtctattactgtgcgaaaggccctcacgatgaaaactacgcccctggcgctatggacgtctggggccaagggaccacggtcaccgtctcctcagcctccaccaagggcccatcggtcttcccctc

SEQ ID NO: 449376 - DNA, 515 bp, Homo sapiens
  misc_feature: HEFZJCU01DFG5F.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctcg

SEQ ID NO: 449377 - DNA, 518 bp, Homo sapiens; identical to SEQ ID NO: 445220
  misc_feature: HEFZJCU01BSS5T.9.70.G04.1.454.heavy.3.raw

SEQ ID NO: 449378 - DNA, 506 bp, Homo sapiens; identical to SEQ ID NO: 448877
  misc_feature: HEFZJCU01BDPQM.13.37.D04.1.454.heavy.3.raw

SEQ ID NO: 449379 - DNA, 512 bp, Homo sapiens
  misc_feature: HEFZJCU01BUA2M.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaaggactacttcccatac

SEQ ID NO: 449380 - DNA, 487 bp, Homo sapiens
  misc_feature: HEFZJCU01D29PC.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggccatcggtcttcccctggcaccctcctccaagagcacctctgggggcacagcggccctgggctgcctggtcaaggactactccgagcgtct

SEQ ID NO: 449381 - DNA, 518 bp, Homo sapiens; identical to SEQ ID NO: 444718
  misc_feature: HEFZJCU01DKKX5.9.34.D01.1.454.heavy.3.raw

SEQ ID NO: 449382 - DNA, 519 bp, Homo sapiens
  misc_feature: HEFZJCU01CXXD4.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtacac

SEQ ID NO: 449383 - DNA, 504 bp, Homo sapiens
  misc_feature: HEFZJCU01EV68D.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctcggcaccctcctccaagagcacctctgggggcacagcggccctgggctgcctggtcaaggactacttccgctacgtaga

SEQ ID NO: 449384 - DNA, 488 bp, Homo sapiens
  misc_feature: HEFZJCU01CSZ21.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctcggcgccctgctccaggagcacctccgagagcacagcggccctgggctgcctggtcaaggactacttcctacgtgagct

SEQ ID NO: 449385 - DNA, 336 bp, Homo sapiens; identical to SEQ ID NO: 444510
  misc_feature: HEFZJCU01CQ8X4.3.31.C09.1.454.heavy.3.raw

SEQ ID NO: 449386 - DNA, 489 bp, Homo sapiens; identical to SEQ ID NO: 444591
  misc_feature: HEFZJCU01CWHB4.18.70.G04.1.454.heavy.3.raw

SEQ ID NO: 449387 - DNA, 509 bp, Homo sapiens
  misc_feature: HEFZJCU01DO7GF.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactctttgaccagtgggcgggaacccgtggtcaccgtctcttcagcctccaccaaggcccatcggtcttcccctggcaccctcctccagagcacctctggggcac

SEQ ID NO: 449388 - DNA, 515 bp, Homo sapiens
  misc_feature: HEFZJCU01CZTV0.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaactgagagcgacgacacggccgttattactgtgcgagagattcgagtggttcggggacctccaccctcggttctacttcgtatctc

SEQ ID NO: 449389 - DNA, 423 bp, Homo sapiens; identical to SEQ ID NO: 444772
  misc_feature: HEFZJCU01C8VVE.16.78.H01.1.454.heavy.3.raw

SEQ ID NO: 449390 - DNA, 521 bp, Homo sapiens
  misc_feature: HEFZJCU01C9B4L.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctgggcc

SEQ ID NO: 449391 - DNA, 506 bp, Homo sapiens
  misc_feature: HEFZJCU01CKJX6.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggcctgggctgcctggtcaaggactactccgagtgcgtct

SEQ ID NO: 449392 - DNA, 370 bp, Homo sapiens; identical to SEQ ID NO: 445884
  misc_feature: HEFZJCU01C70RE.3.42.D09.1.454.heavy.3.raw

SEQ ID NO: 449393 - DNA, 501 bp, Homo sapiens
  misc_feature: HEFZJCU01D087U.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttctc

SEQ ID NO: 449394 - DNA, 517 bp, Homo sapiens
  misc_feature: HEFZJCU01BOIXY.49.38.D05.1.454.heavy.3.raw
agtcgagagacacgaccggtgctcgatttagtatctgatagttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccccaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggcaccctcctccaagagcacctctgggggcacagcggccctgggctgcctggtcaaggactactcctctctcgact

SEQ ID NO: 449395 - DNA, 489 bp, Homo sapiens; identical to SEQ ID NO: 444791
  misc_feature: HEFZJCU01D4RY0.47.85.H08.1.454.heavy.3.raw

SEQ ID NO: 449396 - DNA, 517 bp, Homo sapiens
  misc_feature: HEFZJCU01DISP9.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcccgtgggctcgg

SEQ ID NO: 449397 - DNA, 524 bp, Homo sapiens
  misc_feature: HEFZJCU01DYO0B.49.71.G05.1.454.heavy.3.raw
agtcgagagacacgaccggtgctcgatttagtgtcgtcgcaagagagagggggctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctattactgtgcacgacgccgttataccagaggctggtaccttgactcctggggccagggcaccctggtcaccgtctcctcag

SEQ ID NO: 449398 - DNA, 423 bp, Homo sapiens; identical to SEQ ID NO: 444772
  misc_feature: HEFZJCU01B5A96.16.78.H01.1.454.heavy.3.raw

SEQ ID NO: 449399 - DNA, 497 bp, Homo sapiens
  misc_feature: HEFZJCU01EPJOA.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctcgtgggccaagggacactggtcaccgtctcttcagcctccaccaaggcccatcgtctcccctggccgcctgctc

SEQ ID NO: 449400 - DNA, 513 bp, Homo sapiens; identical to SEQ ID NO: 446452
  misc_feature: HEFZJCU01EZQKC.17.33.C11.1.454.heavy.3.raw

SEQ ID NO: 449401 - DNA, 524 bp, Homo sapiens
  misc_feature: HEFZJCU01ERTY5.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgtttacgatttttggactggcccgttggggtactcctacggtttggacgtctggggccaagggaccacggtcaccgtctcctcagcctccaccaagggcccatcggtcttcccctggccgccctgctccaggagcacctccgagagcacagcggccctgggctgcctggtcaaggactacttcccgtgtctgat

SEQ ID NO: 449402 - DNA, 443 bp, Homo sapiens
  misc_feature: HEFZJCU01DQRZV.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttaggttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacag

SEQ ID NO: 449403 - DNA, 427 bp, Homo sapiens
  misc_feature: HEFZJCU01DKPB0.9.34.D01.1.454.heavy.3.raw
tgatacgtctcacgaccggtgctcgatttagatcgtctgtgttgggtttgggattcacgttgcagatgtaggtctgggtcgcaggcatggctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 449404 - DNA, 499 bp, Homo sapiens; identical to SEQ ID NO: 446805
  misc_feature: HEFZJCU01C8GBW.3.20.B09.1.454.heavy.3.raw

SEQ ID NO: 449405 - DNA, 320 bp, Homo sapiens; identical to SEQ ID NO: 445022
  misc_feature: HEFZJCU01C5U24.14.28.C06.1.454.heavy.3.raw

SEQ ID NO: 449406 - DNA, 395 bp, Homo sapiens
  misc_feature: HEFZJCU01A191C.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctggggcacagcggccctgggctgcctggtcaaggactacttcccatactcgta

SEQ ID NO: 449407 - DNA, 482 bp, Homo sapiens
  misc_feature: HEFZJCU01DAQC9.47.59.F04.1.454.heavy.3.raw
  modified_base (433)..(433): a, c, t, g, unknown or other
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagngcacagcggccctgggctgcctggtcaaggactacttcctacgtgagct

SEQ ID NO: 449408 - DNA, 493 bp, Homo sapiens
  misc_feature: HEFZJCU01B8JM9.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggccaccctcctccaagagcacctctgggggcacagcggccctgggctgcctggtcaaggactacttccgagtgcgtct

SEQ ID NO: 449409 - DNA, 491 bp, Homo sapiens; identical to SEQ ID NO: 446104
  misc_feature: HEFZJCU01EW00W.3.34.D01.1.454.heavy.3.raw

SEQ ID NO: 449410 - DNA, 500 bp, Homo sapiens; identical to SEQ ID NO: 445720
  misc_feature: HEFZJCU01BAGRL.3.20.B09.1.454.heavy.3.raw

SEQ ID NO: 449411 - DNA, 507 bp, Homo sapiens
  misc_feature: HEFZJCU01BO4C4.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacgacatgactaccg

SEQ ID NO: 449412 - DNA, 374 bp, Homo sapiens; identical to SEQ ID NO: 444640
  misc_feature: HEFZJCU01B0EYP.7.37.D04.1.454.heavy.3.raw

SEQ ID NO: 449413 - DNA, 504 bp, Homo sapiens; identical to SEQ ID NO: 445353
  misc_feature: HEFZJCU01A0GJX.10.38.D05.1.454.heavy.3.raw

SEQ ID NO: 449414 - DNA, 368 bp, Homo sapiens
  misc_feature: HEFZJCU01DLMC0.19.53.E09.1.454.heavy.3.raw
tactctcgtgcacgaccggtgctcgatttagagagagtgtgttgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 449415 - DNA, 510 bp, Homo sapiens
  misc_feature: HEFZJCU01EJ3IX.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagaggggaagtgggatattgtggcagctccaggtgcccaggcccgggcccctactttgactactc

SEQ ID NO: 449416 - DNA, 500 bp, Homo sapiens
  misc_feature: HEFZJCU01CCSHX.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaaagtggtccttacaatgaccaacatggaccctttggacacagccacatattactgtgcacaccacagggtctctactgctggctttcagtacaactggttcgaaccctggggccagggaaccctggtcagcgtctcctcagcct

SEQ ID NO: 449417 - DNA, 528 bp, Homo sapiens
  misc_feature: HEFZJCU01D59DC.16.27.C05.1.454.heavy.3.raw
  modified_base (521)..(521): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtgggggccggggagccccgggtnatcgtct

SEQ ID NO: 449418 - DNA, 516 bp, Homo sapiens; identical to SEQ ID NO: 448976
  misc_feature: HEFZJCU01BQ5I2.7.78.H01.1.454.heavy.3.raw

SEQ ID NO: 449419 - DNA, 499 bp, Homo sapiens
  misc_feature: HEFZJCU01EAVQC.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggac

SEQ ID NO: 449420 - DNA, 499 bp, Homo sapiens; identical to SEQ ID NO: 445690
  misc_feature: HEFZJCU01AZE5O.3.81.H04.1.454.heavy.3.raw

SEQ ID NO: 449421 - DNA, 391 bp, Homo sapiens
  misc_feature: HEFZJCU01CQ15G.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgactggtcaaggactacttcctacgtcgtat

SEQ ID NO: 449422 - DNA, 506 bp, Homo sapiens
  misc_feature: HEFZJCU01C5G35.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctgacaccctcctccaagagcacctctgggggcacagcggccctgggctgcctggtcaaggactacttccgagtagtaca

SEQ ID NO: 449423 - DNA, 384 bp, Homo sapiens; identical to SEQ ID NO: 444454
  misc_feature: HEFZJCU01AMY4X.11.61.F06.1.454.heavy.3.raw

SEQ ID NO: 449424 - DNA, 521 bp, Homo sapiens
  misc_feature: HEFZJCU01EPSCF.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttccccctggcgccctgctcccaggagcacctccgagagcacagcggccctgggctgcctggtcaaggactattcctacg

SEQ ID NO: 449425 - DNA, 513 bp, Homo sapiens
  misc_feature: HEFZJCU01BKWLO.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactgggggcca

SEQ ID NO: 449426 - DNA, 436 bp, Homo sapiens; identical to SEQ ID NO: 444686
  misc_feature: HEFZJCU01CY51F.40.27.C05.1.454.heavy.3.raw

SEQ ID NO: 449427 - DNA, 492 bp, Homo sapiens
  misc_feature: HEFZJCU01BT2ND.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccactggggccagggaaccctgggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 449428 - DNA, 485 bp, Homo sapiens
  misc_feature: HEFZJCU01BVKSE.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtctcccctggcgccctgctccaggagcacctccgagagcacagcggccctgggctgcctggtcaaggactacttcctacgtgagct

SEQ ID NO: 449429 - DNA, 500 bp, Homo sapiens
  misc_feature: HEFZJCU01DNS92.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctcaccaagggcccatcggtcttcccctggcgccctgctccaggagcacctccgagagcacagcggccctgggctgcctggtcaaggactacttcctatgtatact

SEQ ID NO: 449430 - DNA, 539 bp, Homo sapiens
  misc_feature: HEFZJCU01EB627.18.59.F04.1.454.heavy.3.raw
  modified_base (498)..(498): a, c, t, g, unknown or other
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcaacgctgtatctgcaaatgaacagcctgagaaccgaggacacagccgtgtattactgtaccacatccctgaaacncgtacaactactactactacggtatcgacctcgtgggaccg

SEQ ID NO: 449431 - DNA, 520 bp, Homo sapiens
  misc_feature: HEFZJCU01EGRV5.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggacctggtcatcgtctccccagcctccaccaagggcccatcggtcttccccctggcg

SEQ ID NO: 449432 - DNA, 529 bp, Homo sapiens
  misc_feature: HEFZJCU01C77FK.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggcccaggggaaccctggtcaccgtctcctcagcctccaccg

SEQ ID NO: 449433 - DNA, 432 bp, Homo sapiens; identical to SEQ ID NO: 444920
  misc_feature: HEFZJCU01C7XFJ.11.39.D06.1.454.heavy.3.raw

SEQ ID NO: 449434 - DNA, 520 bp, Homo sapiens
  misc_feature: HEFZJCU01D2T1Y.12.71.G05.1.454.heavy.3.raw
  modified_base (419)..(419): a, c, t, g, unknown or other
  modified_base (467)..(467): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccagggtcaccgtctcctcngcctccaccaagggcccatccgtcttcccctggcgccctgctccaggngcacctccgagagcacagcggccctgggctgcctggtcaaggctactcctacg

SEQ ID NO: 449435 - DNA, 506 bp, Homo sapiens
  misc_feature: HEFZJCU01EV8FM.12.55.E11.1.454.heavy.3.raw
atacgacgtacacgaccggtgctcgatttagcactcgcacgttgggtttggggagacgagcccagcactggaagtcgccggtgtttccattcggtgatcatcactgaacacagaggactcaccatggagtttgggctgagcgtggtttcgtcgtaggctctttaagtaggtgtccagtgtcagatgcagctggtggagtctgggggaggcgtggtccggcctgggacgtccctgacactctcctgtgcagccgctggattcacccttacccagttatgctatgcactgggtccgccaggctccaggggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttttctggttatttcg

SEQ ID NO: 449436 - DNA, 508 bp, Homo sapiens
  misc_feature: HEFZJCU01AK6YW.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaaggcccatcggtcttcccctggcaccctcctccaagagcacctctgggggcacagcggccctgggctgcctggtcaaggactacttcctacgtcgtat

SEQ ID NO: 449437 - DNA, 408 bp, Homo sapiens
  misc_feature: HEFZJCU01C4RBO.49.62.F07.1.454.heavy.3.raw
agtcgagagacacgaccggtgctcgatttagtagtcgcataaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctggggcacagcggccctgggctgcctggtcaaggactacttcctctctcgact

SEQ ID NO: 449438 - DNA, 511 bp, Homo sapiens
  misc_feature: HEFZJCU01EGSM7.48.37.D04.1.454.heavy.3.raw
agtatacatacacgaccggtgctcgatttagtagcatactgttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcctggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtccttcccctggcgccctgctccaggagcacctccgagagcacagcggccctgggctgccg

SEQ ID NO: 449439 - DNA, 507 bp, Homo sapiens
  misc_feature: HEFZJCU01DNGUI.16.21.B10.1.454.heavy.3.raw
  modified_base (462)..(462): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtcggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtncgaaagcaccggcagttagtcacccatactactttgactactggg

SEQ ID NO: 449440 - DNA, 386 bp, Homo sapiens; identical to SEQ ID NO: 444449
  misc_feature: HEFZJCU01B7U00.27.46.E02.1.454.heavy.3.raw

SEQ ID NO: 449441 - DNA, 506 bp, Homo sapiens; identical to SEQ ID NO: 444696
  misc_feature: HEFZJCU01DGBTJ.16.34.D01.1.454.heavy.3.raw

SEQ ID NO: 449442 - DNA, 498 bp, Homo sapiens; identical to SEQ ID NO: 448922
  misc_feature: HEFZJCU01BJMQC.11.73.G07.1.454.heavy.3.raw

SEQ ID NO: 449443 - DNA, 519 bp, Homo sapiens
  misc_feature: HEFZJCU01DI68N.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtccgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 449444 - DNA, 497 bp, Homo sapiens; identical to SEQ ID NO: 447711
  misc_feature: HEFZJCU01AKFGN.16.37.D04.1.454.heavy.3.raw

SEQ ID NO: 449445 - DNA, 529 bp, Homo sapiens
  misc_feature: HEFZJCU01DXW8L.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccgccctcg

SEQ ID NO: 449446 - DNA, 502 bp, Homo sapiens
  misc_feature: HEFZJCU01CMT4H.52.38.D05.1.454.heavy.3.raw
cgcagtacgacacgaccggtgctcgatttagtatctgatagttgggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctaccggctgctacttcgatctctggggccgtggcacctggtcactgtcttctcagcctccaccaagggcccatcggtcttcccctggcaccctcctccaaga

SEQ ID NO: 449447 - DNA, 518 bp, Homo sapiens
  misc_feature: HEFZJCU01A5AYA.52.33.C11.1.454.heavy.3.raw
cgcagtacgacacgaccggtgctcgatttagagtgagctcgttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacga

SEQ ID NO: 449448 - DNA, 425 bp, Homo sapiens
  misc_feature: HEFZJCU01CHR69.16.53.E09.1.454.heavy.3.raw
tgtactactccacgaccggtgctcgatttagagagagtgtgttgggtttgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgacaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 449449 - DNA, 316 bp, Homo sapiens; identical to SEQ ID NO: 444479
  misc_feature: HEFZJCU01BDTUN.47.84.H07.1.454.heavy.3.raw

SEQ ID NO: 449450 - DNA, 349 bp, Homo sapiens
  misc_feature: HEFZJCU01C5C1Z.40.36.D03.1.454.heavy.3.raw
tctagcgactcacgaccggtgctcgatttagctgcgtcacgatctctcttggggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttccagtcactaga

SEQ ID NO: 449451 - DNA, 323 bp, Homo sapiens
  misc_feature: HEFZJCU01ANZWZ.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcaccctcctccaagagcacctctggggcacagcggccctgggctgcctggtcaaggactacttcccatactcgta

SEQ ID NO: 449452 - DNA, 522 bp, Homo sapiens
  misc_feature: HEFZJCU01AY7X3.49.28.C06.1.454.heavy.3.raw
agtcgagagacacgaccggtgctcgatttagagctcacgtattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcctcc

SEQ ID NO: 449453 - DNA, 524 bp, Homo sapiens
  misc_feature: HEFZJCU01CMRI7.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagcgtgggttttccgttgttaggctattattaaaagggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattt

SEQ ID NO: 449454 - DNA, 406 bp, Homo sapiens
  misc_feature: HEFZJCU01BWDTI.51.77.G11.1.454.heavy.3.raw
cgatcgtatacacgaccggtgctcgatttagctagtcactcaagggaaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtcgacccccgtccgctcggtgcggaggtctggggccaagggaccacggtcatcgtctcctcagcctccaccaagggcccatcggtcttccccctggcaccctcctccaagagcacctctggggcacagcggccctgggctgcctggtcaaggactacttcctcgtagcact

SEQ ID NO: 449455 - DNA, 512 bp, Homo sapiens
  misc_feature: HEFZJCU01DYAKF.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcacccatactactttgactctgggccg

SEQ ID NO: 449456 - DNA, 540 bp, Homo sapiens
  misc_feature: HEFZJCU01CYIRA.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccgaagggacgctggtcaccgtctcttcagcctccaccaagggcccatcggtcttcccctggccaccctcctccaagagcacctctgggggcacagcc

SEQ ID NO: 449457 - DNA, 507 bp, Homo sapiens
  misc_feature: HEFZJCU01BL46H.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaacagcgggagtccaagtactcctt

SEQ ID NO: 449458 - DNA, 384 bp, Homo sapiens; identical to SEQ ID NO: 444454
  misc_feature: HEFZJCU01AX2ZY.11.61.F06.1.454.heavy.3.raw

SEQ ID NO: 449459 - DNA, 489 bp, Homo sapiens; identical to SEQ ID NO: 444591
  misc_feature: HEFZJCU01C5BYI.18.70.G04.1.454.heavy.3.raw

SEQ ID NO: 449460 - DNA, 515 bp, Homo sapiens
  misc_feature: HEFZJCU01C8IQV.40.9.A09.1.454.heavy.3.raw
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagccctgacagccgaggacacggctgtttattactgtgcgagagatggcactcggggcggtgactttgactactgggccac

SEQ ID NO: 449461 - DNA, 396 bp, Homo sapiens
  misc_feature: HEFZJCU01BD5AA.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctggggacacagcggccctgggctgcctggtcaaggactacttcccatactcgta

SEQ ID NO: 449462 - DNA, 488 bp, Homo sapiens; identical to SEQ ID NO: 447044
  misc_feature: HEFZJCU01DPBXT.18.70.G04.1.454.heavy.3.raw

SEQ ID NO: 449463 - DNA, 517 bp, Homo sapiens
  misc_feature: HEFZJCU01DGCVQ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtctcccctggcaccctcctccaagagcacctctgggggcacagcggccctgggctgcctggtcaaggactacttccagacgtatca

SEQ ID NO: 449464 - DNA, 511 bp, Homo sapiens; identical to SEQ ID NO: 445268
  misc_feature: HEFZJCU01ER4HG.48.34.D01.1.454.heavy.3.raw

SEQ ID NO: 449465 - DNA, 402 bp, Homo sapiens
  misc_feature: HEFZJCU01CY7UK.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggcctgggctgcctggtcaaggactacttccgagtagtaca

SEQ ID NO: 449466 - DNA, 532 bp, Homo sapiens; identical to SEQ ID NO: 445228
  misc_feature: HEFZJCU01AXOH8.7.78.H01.1.454.heavy.3.raw

SEQ ID NO: 449467 - DNA, 532 bp, Homo sapiens; identical to SEQ ID NO: 445228
  misc_feature: HEFZJCU01EP0Q1.7.78.H01.1.454.heavy.3.raw

SEQ ID NO: 449468 - DNA, 497 bp, Homo sapiens
  misc_feature: HEFZJCU01CUOWN.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactac

SEQ ID NO: 449469 - DNA, 528 bp, Homo sapiens
  misc_feature: HEFZJCU01B0JES.7.70.G04.1.454.heavy.3.raw
cgtgtctctacacgaccggtgctcgatttagtgtagtgtgaagggaaagggtctgtgaaggcttcaccagtcctggacctccttgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccaggggaaccctggtcaccgtctcctcagcctccaccg

SEQ ID NO: 449470 - DNA, 506 bp, Homo sapiens; identical to SEQ ID NO: 444696
  misc_feature: HEFZJCU01DCGRL.16.34.D01.1.454.heavy.3.raw

SEQ ID NO: 449471 - DNA, 506 bp, Homo sapiens
  misc_feature: HEFZJCU01EYUL4.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaaagataccaaccccttacgtactttttggagtt

SEQ ID NO: 449472 - DNA, 491 bp, Homo sapiens; identical to SEQ ID NO: 445333
  misc_feature: HEFZJCU01EJ7XS.19.53.E09.1.454.heavy.3.raw

SEQ ID NO: 449473 - DNA, 517 bp, Homo sapiens
  misc_feature: HEFZJCU01D4IKI.52.52.E08.1.454.heavy.3.raw
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaatctatcatactgggaacaccaactacagcccgtccctcaagagtcgagtcgccatatcactagaccaggcgaacaacgagttctccctgaaactgagctctgtgaccgccgcagacacggccgtggtattattgtgggagagatcggagagatagtagtggtttttactacggtgactacgacggtatggacgtctggggccaagggaccacggtc

SEQ ID NO: 449474 - DNA, 531 bp, Homo sapiens
  misc_feature: HEFZJCU01CXMRC.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtggggtggcacttattgcacatgatggcgtcaacaaattctacgcaaattccgtgagggggccgattcaccatctccagagacaattacaagaacaccctttatcttcaaatagacagcctgagaccagacgacacggctgtctattattgcgcgagagagacacacgaacctactggccaatactatgggggcttgttctggggccagggggaccctggtcatcgtctccccagcctccaccaagggcccatccggtcttccccctggcgccctg

SEQ ID NO: 449475 - DNA, 509 bp, Homo sapiens; identical to SEQ ID NO: 445824
  misc_feature: HEFZJCU01CK3F8.9.14.B03.1.454.heavy.3.raw

SEQ ID NO: 449476 - DNA, 491 bp, Homo sapiens
  misc_feature: HEFZJCU01C3SX6.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgtgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 449477 - DNA, 508 bp, Homo sapiens
  misc_feature: HEFZJCU01CV24I.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacagtggcagctccaagtacttac

SEQ ID NO: 449478 - DNA, 519 bp, Homo sapiens; identical to SEQ ID NO: 445617
  misc_feature: HEFZJCU01EH6Y1.9.34.D01.1.454.heavy.3.raw

SEQ ID NO: 449479 - DNA, 525 bp, Homo sapiens
  misc_feature: HEFZJCU01CM1U7.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactggggccagggaaccctggtcaccgtctcctcagcctccaccaagggcccatcggtcttcccctcggcgccctcgctcca

SEQ ID NO: 449480 - DNA, 396 bp, Homo sapiens; identical to SEQ ID NO: 444469
  misc_feature: HEFZJCU01D8U8P.47.46.E02.1.454.heavy.3.raw

SEQ ID NO: 449481 - DNA, 509 bp, Homo sapiens
  misc_feature: HEFZJCU01CR6QU.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttatagtccctactttgactactgggccagggaactctggtcaccgtctccgcagcctcaccaaggccc

SEQ ID NO: 449482 - DNA, 508 bp, Homo sapiens; identical to SEQ ID NO: 445594
  misc_feature: HEFZJCU01ACKRF.17.25.C03.1.454.heavy.3.raw

SEQ ID NO: 449483 - DNA, 519 bp, Homo sapiens; identical to SEQ ID NO: 445330
  misc_feature: HEFZJCU01AY2W1.7.78.H01.1.454.heavy.3.raw

SEQ ID NO: 449484 - DNA, 491 bp, Homo sapiens; identical to SEQ ID NO: 447127
  misc_feature: HEFZJCU01A5RB6.12.75.G09.1.454.heavy.3.raw

SEQ ID NO: 449485 - DNA, 492 bp, Homo sapiens; identical to SEQ ID NO: 444827
  misc_feature: HEFZJCU01CND5R.4.28.C06.1.454.heavy.3.raw

SEQ ID NO: 449486 - DNA, 479 bp, Homo sapiens
  misc_feature: HEFZJCU01CQSNI.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgttgcgagagaga

SEQ ID NO: 449487 - DNA, 476 bp, Homo sapiens
  misc_feature: HEFZJCU01EFJX0.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctggctgcctggtcaaggactacttccgagtagtaca

SEQ ID NO: 449488 - DNA, 508 bp, Homo sapiens
  misc_feature: HEFZJCU01CUD3R.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttgggggcttttgaccactggggccagggaaccctggtcaccgtctcttcagcctccaccaagggcccatcggtcttccccctggcaccctcctccaagagcacctctgggggcacagcggccctgggctgcctggtcaaggactacttccgtactagacg

SEQ ID NO: 449489 - DNA, 415 bp, Homo sapiens; identical to SEQ ID NO: 444794
  misc_feature: HEFZJCU01DJ4XA.14.74.G08.1.454.heavy.3.raw

SEQ ID NO: 449490 - DNA, 526 bp, Homo sapiens
  misc_feature: HEFZJCU01CWY2Y.49.25.C03.1.454.heavy.3.raw
agtcgagagacacgaccggtgctcgatttagtagtgtagatttgggtttgggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaaccccggtcaccgtctcctctgcctccaccaagggcccatcggtcttcccctggcaccctcctccaagagcacctctgggggcacagcggccctgggctgcc

SEQ ID NO: 449491 - DNA, 506 bp, Homo sapiens; identical to SEQ ID NO: 445682
  misc_feature: HEFZJCU01EPGQA.48.44.D11.1.454.heavy.3.raw

SEQ ID NO: 449492 - DNA, 506 bp, Homo sapiens; identical to SEQ ID NO: 445682
  misc_feature: HEFZJCU01CLMWB.48.44.D11.1.454.heavy.3.raw

SEQ ID NO: 449493 - DNA, 516 bp, Homo sapiens
  misc_feature: HEFZJCU01DJ111.16.38.D05.1.454.heavy.3.raw
  modified_base (474)..(474): a, c, t, g, unknown or other
  modified_base (484)..(484): a, c, t, g, unknown or other
tgtactactccacgaccggtgctcgatttagtatctgatagttgggtttgggctcaactctcttgtctcaccatggagtttgggctgagcgtggtttcgtcgttaacgtctttaagaggtgtccaatgtcaggtgcagttggtggagtctgggggaggcgtggtccagcctggaaggtccctgagactctcgtgtgcagcgtctggattcatctttaatagtttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgttgtgagactcttattgcgttcgggctttgactacttggggccagggatccctgtcncgtctcctcngcctccaccaagggcccatcggtcttcccctc

SEQ ID NO: 449494 - DNA, 395 bp, Homo sapiens; identical to SEQ ID NO: 444517
  misc_feature: HEFZJCU01EWHYS.16.68.G02.1.454.heavy.3.raw

SEQ ID NO: 449495 - DNA, 515 bp, Homo sapiens
  misc_feature: HEFZJCU01AWIOB.49.34.D01.1.454.heavy.3.raw
agtcgagagacacgaccggtgctcgatttagatcgtctgtgttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggccaccctcctccaagacgcacctctgggggcacagcggccctgggctgcctggtcaaggactacttcctctctcgact

SEQ ID NO: 449496 - DNA, 483 bp, Homo sapiens; identical to SEQ ID NO: 444932
  misc_feature: HEFZJCU01E1FOP.7.10.A10.1.454.heavy.3.raw

SEQ ID NO: 449497 - DNA, 437 bp, Homo sapiens; identical to SEQ ID NO: 444603
  misc_feature: HEFZJCU01AWL4F.3.21.B10.1.454.heavy.3.raw

SEQ ID NO: 449498 - DNA, 519 bp, Homo sapiens; identical to SEQ ID NO: 446650
  misc_feature: HEFZJCU01EXJMZ.13.76.G10.1.454.heavy.3.raw

SEQ ID NO: 449499 - DNA, 480 bp, Homo sapiens; identical to SEQ ID NO: 445011
  misc_feature: HEFZJCU01DAUAA.22.36.D03.1.454.heavy.3.raw

SEQ ID NO: 449500 - DNA, 501 bp, Homo sapiens
  misc_feature: HEFZJCU01B0QZ3.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttc

SEQ ID NO: 449501 - DNA, 503 bp, Homo sapiens
  misc_feature: HEFZJCU01CZDYH.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagattattttcgttattgttctggtgtgtgtgttcaatgtttgaccattc

SEQ ID NO: 449502 - DNA, 517 bp, Homo sapiens
  misc_feature: HEFZJCU01DOPUF.10.85.H08.1.454.heavy.3.raw
catagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggccc

SEQ ID NO: 449503 - DNA, 519 bp, Homo sapiens
  misc_feature: HEFZJCU01ELYLT.53.82.H05.1.454.heavy.3.raw
cgcgtatacacacgaccggtgctcgatttagtcgagctctctcgcgggcacgaccggtgctcgatttagtgtgagtagtttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccccgtggggccgagggaaccctggtcaccgtctcctcagcttccaccaagggcccatcggtcttcccctggcgccctgctccacggagcacctcgtcgggggcacgagcggtcccgg

SEQ ID NO: 449504 - DNA, 377 bp, Homo sapiens; identical to SEQ ID NO: 444596
  misc_feature: HEFZJCU01DW3O3.47.77.G11.1.454.heavy.3.raw

SEQ ID NO: 449505 - DNA, 374 bp, Homo sapiens; identical to SEQ ID NO: 444640
  misc_feature: HEFZJCU01C6RZU.7.37.D04.1.454.heavy.3.raw

SEQ ID NO: 449506 - DNA, 501 bp, Homo sapiens
  misc_feature: HEFZJCU01CDJDE.51.35.D02.1.454.heavy.3.raw
cgatcgtatacacgaccggtgctcgatttagcacacgatagttgggtttggggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggtcatcgtctcttcggcctccaccaagggcccatcggtcttcccctggcaccctcctccaagagcacctctgggggcacagcggccctgggctgcctggtcaaggactacttcctcg

SEQ ID NO: 449507 - DNA, 492 bp, Homo sapiens
  misc_feature: HEFZJCU01CKJSU.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 449508 - DNA, 526 bp, Homo sapiens
  misc_feature: HEFZJCU01ETN6P.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccggaacctggtcaccgtctctcagcctccaccaaggcccatcggtccttcccctgccaccctcctcc

SEQ ID NO: 449509 - DNA, 513 bp, Homo sapiens
  misc_feature: HEFZJCU01C17JR.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacgggaaaccttgactactggggccaggggaaccctggtcaccgt

SEQ ID NO: 449510 - DNA, 490 bp, Homo sapiens
  misc_feature: HEFZJCU01EYR7N.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 449511 - DNA, 506 bp, Homo sapiens; identical to SEQ ID NO: 445682
  misc_feature: HEFZJCU01D9HRB.48.44.D11.1.454.heavy.3.raw

SEQ ID NO: 449512 - DNA, 508 bp, Homo sapiens
  misc_feature: HEFZJCU01DJ05Z.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactacgtgggccagggcaccctggtcaccgtctcctcagcttccaccaagggcccatcggtcttcccctggccgccctgctccaggagcacctctgggggcacagcgcctgggctgcctggtcaaggactactccatac

SEQ ID NO: 449513 - DNA, 407 bp, Homo sapiens; identical to SEQ ID NO: 445632
  misc_feature: HEFZJCU01C3V1I.11.67.G01.1.454.heavy.3.raw

SEQ ID NO: 449514 - DNA, 517 bp, Homo sapiens
  misc_feature: HEFZJCU01CH3W2.13.76.G10.1.454.heavy.3.raw
tcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatagtagtggtagtacatactccgcagactccgtgaggggccgattcaccatctccagagacaattccaagaacacgctgttcttcaaatgaacagcctgagagccgatgacacggccgtgtattactgtgcgagagagtggggcccacgaacgttactacgctatggacgtctggggccgagggaccg

SEQ ID NO: 449515 - DNA, 512 bp, Homo sapiens; identical to SEQ ID NO: 446702
  misc_feature: HEFZJCU01AQJLP.14.25.C03.1.454.heavy.3.raw

SEQ ID NO: 449516 - DNA, 368 bp, Homo sapiens; identical to SEQ ID NO: 449414
  misc_feature: HEFZJCU01DGBA6.19.53.E09.1.454.heavy.3.raw

SEQ ID NO: 449517 - DNA, 518 bp, Homo sapiens
  misc_feature: HEFZJCU01AJIPZ.48.53.E09.1.454.heavy.3.raw
agtatacatacacgaccggtgctcgatttagagagagtgtgttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccccgtggggccaggggatacctggtctaccg

SEQ ID NO: 449518 - DNA, 484 bp, Homo sapiens
  misc_feature: HEFZJCU01EZHVH.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtgacccctgactgataaaccggactggttcgacccctggggccagggaaccct

SEQ ID NO: 449519 - DNA, 484 bp, Homo sapiens
  misc_feature: HEFZJCU01AK6AC.49.35.D02.1.454.heavy.3.raw
agtcgagagacacgaccggtgctcgatttagcacacgatagttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaa

SEQ ID NO: 449520 - DNA, 530 bp, Homo sapiens
  misc_feature: HEFZJCU01B5QYU.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtggacacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctggg

SEQ ID NO: 449521 - DNA, 506 bp, Homo sapiens
  misc_feature: HEFZJCU01B8ZJJ.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcctcagcctccaccaagggccc

SEQ ID NO: 449522 - DNA, 515 bp, Homo sapiens
  misc_feature: HEFZJCU01CPWN9.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctgggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctggggcgacagcggcccg

SEQ ID NO: 449523 - DNA, 381 bp, Homo sapiens
  misc_feature: HEFZJCU01CU6MK.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattggtgttaaatgggatggtggctacgactcttggggccggggaaccctggtcaccgtctcttcagcttccaccaagggcccatcggtcttccccctggcgccctgctccaggagcacctctgggggcacagcggccctgggctggcctggtcaaggactacttcctacgtgagct

SEQ ID NO: 449524 - DNA, 443 bp, Homo sapiens; identical to SEQ ID NO: 446583
  misc_feature: HEFZJCU01BHPFP.10.11.A11.1.454.heavy.3.raw

SEQ ID NO: 449525 - DNA, 313 bp, Homo sapiens; identical to SEQ ID NO: 445488
  misc_feature: HEFZJCU01A2TN4.49.8.A08.1.454.heavy.3.raw

SEQ ID NO: 449526 - DNA, 507 bp, Homo sapiens
  misc_feature: HEFZJCU01E0COZ.9.82.H05.1.454.heavy.3.raw
tgatacgtctcacgaccggtgctcgatttagtcgagctctctcgcgggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagtcgacgacacggccatttattactgcgcgaaggatatacgggtcacaacggtggctacgcgttt

SEQ ID NO: 449527 - DNA, 469 bp, Homo sapiens
  misc_feature: HEFZJCU01EUAGK.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggccgccctgcctccaggagccacctccgagagcacagccggccctgggctgcctggtcaaggactacttcccacgagagta

SEQ ID NO: 449528 - DNA, 396 bp, Homo sapiens; identical to SEQ ID NO: 444469
  misc_feature: HEFZJCU01B69Z3.47.46.E02.1.454.heavy.3.raw

SEQ ID NO: 449529 - DNA, 381 bp, Homo sapiens
  misc_feature: HEFZJCU01AR1T2.8.34.D01.1.454.heavy.3.raw
ctcgcgtgtccacgaccggtgctcgatttagatcgtctgtgtgggtggcagttgtttcacctgagggcggtgttcaatggtatgcagactccgtgaagggccgattcaccatctccagagacaattccaggaacacaatgtattggagctgaacagcctaagtcctgaggacacgggcgtatactactgtacgaaggaggggggaaccagcgggagttccaagtactcctttgacgtctggggccagggtaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 449530 - DNA, 516 bp, Homo sapiens
  misc_feature: HEFZJCU01CMEEO.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttacacgctatggacgtctggggccaagggaccg

SEQ ID NO: 449531 - DNA, 516 bp, Homo sapiens
  misc_feature: HEFZJCU01B0KD3.49.78.H01.1.454.heavy.3.raw
agtcgagagacacgaccggtgctcgatttagtgtgagtagtttgggtttgggggggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccaac

SEQ ID NO: 449532 - DNA, 492 bp, Homo sapiens
  misc_feature: HEFZJCU01ECDPH.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgta

SEQ ID NO: 449533 - DNA, 515 bp, Homo sapiens
  misc_feature: HEFZJCU01DXGQI.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctacttgactactgggccagggaactctggtcaccgtctccgcagcctccaccaagggcccatcc

SEQ ID NO: 449534 - DNA, 500 bp, Homo sapiens
  misc_feature: HEFZJCU01D6XTU.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggagtaatagaaagtatgccgacgccgtgaagggccgattcaccatctccagagacaattccaacaacatgttgtatctgcaaatgaatagcctgagagccgaggacacggctgtgtattactgtgtcagagagtggaggggtggtgatccga

SEQ ID NO: 449535 - DNA, 506 bp, Homo sapiens; identical to SEQ ID NO: 444732
  misc_feature: HEFZJCU01B8MXK.14.78.H01.1.454.heavy.3.raw

SEQ ID NO: 449536 - DNA, 395 bp, Homo sapiens
  misc_feature: HEFZJCU01CEIJG.47.46.E02.1.454.heavy.3.raw
agctcacgtacacgaccggtgctcgatttagactcatctacagggaaagggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 449537 - DNA, 491 bp, Homo sapiens
  misc_feature: HEFZJCU01C467A.48.39.D06.1.454.heavy.3.raw
agtatacatacacgaccggtgctcgatttagtgacatctcgcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgacgccttcggagaccctgtccctcacctgcactgtctctggtggctccatcagcagcagtacttacttctggggctggatccgccagcccccaggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtgcttttgatgcctttgatatgtgggccaagggact

SEQ ID NO: 449538 - DNA, 517 bp, Homo sapiens
  misc_feature: HEFZJCU01DNDHE.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggcgccctgctccacggagcacctctgggggcacagcggcccg

SEQ ID NO: 449539 - DNA, 511 bp, Homo sapiens
  misc_feature: HEFZJCU01CD12Y.53.70.G04.1.454.heavy.3.raw
  modified_base (490)..(490): a, c, t, g, unknown or other
cgcgtatacacacgaccggtgctcgatttagtgtagtgtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctgggccgagggaccacggtcaccgtctcctcagcctccaccaagggcccatcggtcttcccctggcgccctgctccaggagcacctccgagagcacagcggccctgggcngcctggtcaaggactacttcc

SEQ ID NO: 449540 - DNA, 484 bp, Homo sapiens
  misc_feature: HEFZJCU01D6EQQ.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagacggccccatacg

SEQ ID NO: 449541 - DNA, 487 bp, Homo sapiens
  misc_feature: HEFZJCU01B4ORX.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctctgggggcacagcggccctgggctgcctggtcaggactacttccatactcgta

SEQ ID NO: 449542 - DNA, 448 bp, Homo sapiens
  misc_feature: HEFZJCU01EZHCU.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttcccctggcgccctgctccaggagcacctccgagagcacagcggccctgggctgcctggtcaaggactactccagacgtatca

SEQ ID NO: 449543 - DNA, 495 bp, Homo sapiens
  misc_feature: HEFZJCU01BGTKS.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccaattcaccatctccagagacaattccaagaacatggtgtatctgcaaatgaccagcctgagagccgaggacacgggtgtttattactgtgggagaaatcctagtggc

SEQ ID NO: 449544 - DNA, 509 bp, Homo sapiens
  misc_feature: HEFZJCU01BPEYP.5.41.D08.1.454.heavy.3.raw
  modified_base (355)..(355): a, c, t, g, unknown or other
atcagacacgcacgaccggtgctcgatttagtcacgcgagaaagggaaaggggggcgatcacataacaaccaggattcctcctctaaagaagcccctgggagcacagctcatcaccatggactggacctggaggttcctctttgtggtggcagcagctacagggtgtccagtcccaggtgcagctggtgcagtctggggctgccgtgaagaagcctgggtcctcggtgacactctcctgcaaggcgtctggtagccaccttcaccaactatgctttcaactgggtgcgacgggcccctgggcaggggacttgagtggctggggcggatcatccctaccgttgatgtggcaaactntgcacagaagttccagggcagagtcacaattaccgcggacaagtccgcgagcacagcctacactggagctggaacaacctgaggatctgaagacacgggccgtctattactgtacgacctgcgctacggtgactaccgctctgcttcgggacct

SEQ ID NO: 449545 - DNA, 396 bp, Homo sapiens; identical to SEQ ID NO: 444469
  misc_feature: HEFZJCU01EHYLK.47.46.E02.1.454.heavy.3.raw

SEQ ID NO: 449546 - DNA, 522 bp, Homo sapiens; identical to SEQ ID NO: 446367
  misc_feature: HEFZJCU01AZE2M.51.62.F07.1.454.heavy.3.raw

SEQ ID NO: 449547 - DNA, 498 bp, Homo sapiens
  misc_feature: HEFZJCU01B9BA0.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggccgccctgctccaggagcacctctgggggcacagcggccctgggctgcctggtcaaggactacttcctacgtcgtat

SEQ ID NO: 449548 - DNA, 520 bp, Homo sapiens
  misc_feature: HEFZJCU01E2ELT.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccactcggtcttccccctcggtccacccc

SEQ ID NO: 449549 - DNA, 427 bp, Homo sapiens
  misc_feature: HEFZJCU01D65Q3.11.26.C04.1.454.heavy.3.raw
cgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 449550 - DNA, 522 bp, Homo sapiens
  misc_feature: HEFZJCU01CJ002.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 449551 - DNA, 324 bp, Homo sapiens; identical to SEQ ID NO: 444475
  misc_feature: HEFZJCU01AR2J1.18.17.B06.1.454.heavy.3.raw

SEQ ID NO: 449552 - DNA, 518 bp, Homo sapiens
  misc_feature: HEFZJCU01C0JVC.48.42.D09.1.454.heavy.3.raw
agtatacatacacgaccggtgctcgatttagacacatacgcagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaagggctggagtggattgggagtatgcactatagtgggagcacccactacacccgtccctcaagagtcgagtcaccatatccgtagacacgtccaagaatcagttctccctgaagctgacctctgtgaccgccgcagacacggctgtttattactgtgtgagacgggtgcccaagaaaagtgttttatccctggggccagggaaccctggtcaccgtctcctcagcctccaccaagggccct

SEQ ID NO: 449553 - DNA, 506 bp, Homo sapiens
  misc_feature: HEFZJCU01COTAK.51.41.D08.1.454.heavy.3.raw
cgatcgtatacacgaccggtgctcgatttagtcacgcgagaaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttcccctggcgccctgctccaggagcacctccgagagcacagcggcccgt

SEQ ID NO: 449554 - DNA, 530 bp, Homo sapiens
  misc_feature: HEFZJCU01CB18V.52.37.D04.1.454.heavy.3.raw
cgcagtacgacacgaccggtgctcgatttagtagcatactgttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttctgggccagggaacccgggtcaccgtctcctcacgcctccaccaagggcccatcggtcttccccctggccaccctcctccaagagcacctctc

SEQ ID NO: 449555 - DNA, 517 bp, Homo sapiens
  misc_feature: HEFZJCU01CK8Z8.4.36.D03.1.454.heavy.3.raw
agcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagcaacaaggaaaacccagctcagccccaattccatggtgagtcctctgtgctcagtgctgatcaccaagtggaaaggccttggagtccagggctaaggctcctctctgagacctccaccaagggcccatcggtcttccccctggcgccctgctccacgagcgactcccgagagcacagcggccctgggcctggcctggtcaaggactacttccctacacg

SEQ ID NO: 449556 - DNA, 500 bp, Homo sapiens; identical to SEQ ID NO: 446033
  misc_feature: HEFZJCU01CU99U.11.27.C05.1.454.heavy.3.raw

SEQ ID NO: 449557 - DNA, 491 bp, Homo sapiens; identical to SEQ ID NO: 445531
  misc_feature: HEFZJCU01BWBZX.11.38.D05.1.454.heavy.3.raw

SEQ ID NO: 449558 - DNA, 396 bp, Homo sapiens; identical to SEQ ID NO: 444469
  misc_feature: HEFZJCU01BLBBT.47.46.E02.1.454.heavy.3.raw

SEQ ID NO: 449559 - DNA, 396 bp, Homo sapiens
  misc_feature: HEFZJCU01CDNWY.47.46.E02.1.454.heavy.3.raw
agctcacgtacacgaccggtgctcgatttagactcatctacagggaagggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 449560 - DNA, 516 bp, Homo sapiens
  misc_feature: HEFZJCU01BYVYP.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctgggctgcctggtcaaggactacttccagactatca

SEQ ID NO: 449561 - DNA, 525 bp, Homo sapiens
  misc_feature: HEFZJCU01CCDYW.49.37.D04.1.454.heavy.3.raw
agtcgagagacacgaccggtgctcgatttagtagcatactgttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattgtgccatgcactggatccgtcaagctccggggaaggtctggatctcagaggtgaggacaccgccttctactactgtgcaaaagattacggtgaccacacctattttgaccactgcggccagggaaccctagtcaccgtctcctcagcctccaccaagggcccatcggtcttccccctggcaccctcctccaagagcacctctgggggcacagcggccctgggctgcctggtcaaggactactt

SEQ ID NO: 449562 - DNA, 402 bp, Homo sapiens
  misc_feature: HEFZJCU01BXQID.47.24.C02.1.454.heavy.3.raw
agctcacgtacacgaccggtgctcgatttagtacagatcgttagggaaagggacgtggagtggattggctatgttcattccagtgggagcaccgactataacctctccctcaagggtcgagtcaccatcttggcagacacgtccaagcaccaattctccctgaagctgacttctatgaccgctgcggacgcggccgtctattattggtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 449563 - DNA, 491 bp, Homo sapiens; identical to SEQ ID NO: 445531
  misc_feature: HEFZJCU01DZYKP.11.38.D05.1.454.heavy.3.raw

SEQ ID NO: 449564 - DNA, 498 bp, Homo sapiens
  misc_feature: HEFZJCU01EEOEE.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctcgtgggggcacagcggccctgggctgcctggtcaaggactacttcctacgtcgtat

SEQ ID NO: 449565 - DNA, 501 bp, Homo sapiens; identical to SEQ ID NO: 445027
  misc_feature: HEFZJCU01EDNQA.26.23.C01.1.454.heavy.3.raw

SEQ ID NO: 449566 - DNA, 508 bp, Homo sapiens
  misc_feature: HEFZJCU01DVAA3.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 449567 - DNA, 315 bp, Homo sapiens; identical to SEQ ID NO: 444422
  misc_feature: HEFZJCU01BB2X1.47.84.H07.1.454.heavy.3.raw

SEQ ID NO: 449568 - DNA, 400 bp, Homo sapiens; identical to SEQ ID NO: 444452
  misc_feature: HEFZJCU01BTZ4B.47.24.C02.1.454.heavy.3.raw

SEQ ID NO: 449569 - DNA, 505 bp, Homo sapiens
  misc_feature: HEFZJCU01CLCWV.52.37.D04.1.454.heavy.3.raw
cgcagtacgacacgaccggtgctcgatttagtagcatactgttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtggggatattgtggcagctccaggtgcccagccggcccccttac

SEQ ID NO: 449570 - DNA, 501 bp, Homo sapiens; identical to SEQ ID NO: 445027
  misc_feature: HEFZJCU01B8C7T.26.23.C01.1.454.heavy.3.raw

SEQ ID NO: 449571 - DNA, 396 bp, Homo sapiens; identical to SEQ ID NO: 444469
  misc_feature: HEFZJCU01CWENR.47.46.E02.1.454.heavy.3.raw

SEQ ID NO: 449572 - DNA, 402 bp, Homo sapiens; identical to SEQ ID NO: 448172
  misc_feature: HEFZJCU01AEOS0.52.66.F11.1.454.heavy.3.raw

SEQ ID NO: 449573 - DNA, 391 bp, Homo sapiens; identical to SEQ ID NO: 444514
  misc_feature: HEFZJCU01EDZLI.12.24.C02.1.454.heavy.3.raw

SEQ ID NO: 449574 - DNA, 495 bp, Homo sapiens
  misc_feature: HEFZJCU01C3F7T.48.39.D06.1.454.heavy.3.raw
agtatacatacacgaccggtgctcgatttagtgacatctcgcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggac

SEQ ID NO: 449575 - DNA, 501 bp, Homo sapiens
  misc_feature: HEFZJCU01CY7WY.12.55.E11.1.454.heavy.3.raw
atacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaagggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcg

SEQ ID NO: 449576 - DNA, 509 bp, Homo sapiens
  misc_feature: HEFZJCU01B2OJV.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagcgtggagtttcctagttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgtcgagcgacccggggctcctcaatggctttcattacg

SEQ ID NO: 449577 - DNA, 324 bp, Homo sapiens; identical to SEQ ID NO: 444475
  misc_feature: HEFZJCU01A0QKS.18.17.B06.1.454.heavy.3.raw

SEQ ID NO: 449578 - DNA, 518 bp, Homo sapiens; identical to SEQ ID NO: 446027
  misc_feature: HEFZJCU01DPHMV.9.34.D01.1.454.heavy.3.raw

SEQ ID NO: 449579 - DNA, 401 bp, Homo sapiens; identical to SEQ ID NO: 448437
  misc_feature: HEFZJCU01BD5CR.11.70.G04.1.454.heavy.3.raw

SEQ ID NO: 449580 - DNA, 511 bp, Homo sapiens; identical to SEQ ID NO: 448079
  misc_feature: HEFZJCU01BYS4W.48.53.E09.1.454.heavy.3.raw

SEQ ID NO: 449581 - DNA, 383 bp, Homo sapiens
  misc_feature: HEFZJCU01CX2GM.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctccgcctccaccaagggcccatcggtcttccccctggcaccctcctccaagagcacctctgggggcacagcggccctgggctgcctggtcaaggactacttcctacgtgagct

SEQ ID NO: 449582 - DNA, 513 bp, Homo sapiens; identical to SEQ ID NO: 446698
  misc_feature: HEFZJCU01ET8CQ.12.55.E11.1.454.heavy.3.raw

SEQ ID NO: 449583 - DNA, 487 bp, Homo sapiens; identical to SEQ ID NO: 445219
  misc_feature: HEFZJCU01DGHDB.10.85.H08.1.454.heavy.3.raw

SEQ ID NO: 449584 - DNA, 484 bp, Homo sapiens
  misc_feature: HEFZJCU01ER1EJ.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctggcgccctgctccaggagcacctccgagagcacagcggccctgggctgcctggtcaaggactacttcccactactatg

SEQ ID NO: 449585 - DNA, 494 bp, Homo sapiens
  misc_feature: HEFZJCU01CBPAQ.21.53.E09.1.454.heavy.3.raw
  modified_base (492)..(492): a, c, t, g, unknown or other
tcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccagggaagggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggnga

SEQ ID NO: 449586 - DNA, 386 bp, Homo sapiens; identical to SEQ ID NO: 444449
  misc_feature: HEFZJCU01AV2R6.27.46.E02.1.454.heavy.3.raw

SEQ ID NO: 449587 - DNA, 512 bp, Homo sapiens
  misc_feature: HEFZJCU01D43K9.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaaggcccatcgtcttcccctggcgccctgctccaggagcacctctgggggcacagcc

SEQ ID NO: 449588 - DNA, 506 bp, Homo sapiens
  misc_feature: HEFZJCU01AGVGO.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctggggccac

SEQ ID NO: 449589 - DNA, 390 bp, Homo sapiens; identical to SEQ ID NO: 444541
  misc_feature: HEFZJCU01D2L5I.16.24.C02.1.454.heavy.3.raw

SEQ ID NO: 449590 - DNA, 484 bp, Homo sapiens; identical to SEQ ID NO: 448254
  misc_feature: HEFZJCU01EVMXD.12.75.G09.1.454.heavy.3.raw

SEQ ID NO: 449591 - DNA, 418 bp, Homo sapiens; identical to SEQ ID NO: 445910
  misc_feature: HEFZJCU01D0PB5.11.62.F07.1.454.heavy.3.raw

SEQ ID NO: 449592 - DNA, 464 bp, Homo sapiens
  misc_feature: HEFZJCU01CMGYO.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggcctgggctgcctggtcaaggactacttcccacgagagta

SEQ ID NO: 449593 - DNA, 548 bp, Homo sapiens
  misc_feature: HEFZJCU01BFDUG.49.37.D04.1.454.heavy.3.raw
agtcgagagacacgaccggtgctcgatttagtagcatactgttgggtttgggtatagacttgggtttggggggaagaggaagactgacggtccccccaggagttcaggtgctgggcacggtgggcaacttatgagcccgaaaggacatggccacggggtgggtagggacatagggccagatgccagcctgaggtggagcctcaggtcacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggtttggatgactcttacttctacttctacgttatggacctctggggccaagggaccacggtcaccgtctcctcagcctccaccaagggcccatcggtcttcccctggcaccctcctccagagcacctctcggggcacg

SEQ ID NO: 449594 - DNA, 459 bp, Homo sapiens
  misc_feature: HEFZJCU01EHE2W.49.5.A05.1.454.heavy.3.raw
agtcgagagacacgaccggtgctcgatttagatagatagacagggggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatca

SEQ ID NO: 449595 - DNA, 477 bp, Homo sapiens; identical to SEQ ID NO: 444659
  misc_feature: HEFZJCU01B27G9.16.10.A10.1.454.heavy.3.raw

SEQ ID NO: 449596 - DNA, 483 bp, Homo sapiens
  misc_feature: HEFZJCU01A850R.19.67.G01.1.454.heavy.3.raw
tactctcgtgcacgaccggtgctcgatttagagtatacatattgggcttggtccagcctgggcggtcgtctgagaacgtgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 449597 - DNA, 479 bp, Homo sapiens; identical to SEQ ID NO: 446215
  misc_feature: HEFZJCU01EJ0GP.22.36.D03.1.454.heavy.3.raw

SEQ ID NO: 449598 - DNA, 511 bp, Homo sapiens; identical to SEQ ID NO: 445268
  misc_feature: HEFZJCU01CM1LQ.48.34.D01.1.454.heavy.3.raw

SEQ ID NO: 449599 - DNA, 411 bp, Homo sapiens; identical to SEQ ID NO: 445580
  misc_feature: HEFZJCU01CLYYS.51.31.C09.1.454.heavy.3.raw

SEQ ID NO: 449600 - DNA, 447 bp, Homo sapiens
  misc_feature: HEFZJCU01DA2BX.51.38.D05.1.454.heavy.3.raw
  modified_base (403)..(403): a, c, t, g, unknown or other
cgatcgtatacacgaccggtgctcgatttagtatctgatagttgggtttgggtagttgggtttggggggaagaggaagactgacggtccccccaggagttcaggtgctggactgggtggcaggcatatcatttgatggaagcaagaagtactatgcagactccgtgaagggccgattcaccatctccagagacagttcccgatggacacagtctatctacacatgagcagtgtgagacctgacgacacggctctttttactgtgcgccaggaagcagtggctggccacatcatgcttttgatatctggagccaagggacaatggtcatcgtctcttcggcctccaccaagggcccatcggtcttcccctggcaccctcctcccaagagcacctctggggcacngcggccctgggctgcctggtcaaggactacttcctcgtagcact

SEQ ID NO: 449601 - DNA, 491 bp, Homo sapiens
  misc_feature: HEFZJCU01EW7W1.3.75.G09.1.454.heavy.3.raw
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcggggggaggcgtggtccagcctggggggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctgtgtattactgtgcgagagagggtttcgcagctcgtccggcgggcccagttgaacatgactatcactactacggtcg

SEQ ID NO: 449602 - DNA, 483 bp, Homo sapiens; identical to SEQ ID NO: 444639
  misc_feature: HEFZJCU01EWK3V.11.23.C01.1.454.heavy.3.raw

SEQ ID NO: 449603 - DNA, 521 bp, Homo sapiens; identical to SEQ ID NO: 445317
  misc_feature: HEFZJCU01ARUZV.12.40.D07.1.454.heavy.3.raw

SEQ ID NO: 449604 - DNA, 379 bp, Homo sapiens; identical to SEQ ID NO: 444450
  misc_feature: HEFZJCU01EPTDG.47.77.G11.1.454.heavy.3.raw

SEQ ID NO: 449605 - DNA, 497 bp, Homo sapiens; identical to SEQ ID NO: 446073
  misc_feature: HEFZJCU01CEVQT.22.78.H01.1.454.heavy.3.raw

SEQ ID NO: 449606 - DNA, 514 bp, Homo sapiens; identical to SEQ ID NO: 449159
  misc_feature: HEFZJCU01B26JO.9.70.G04.1.454.heavy.3.raw

SEQ ID NO: 449607 - DNA, 507 bp, Homo sapiens
  misc_feature: HEFZJCU01EQX57.48.81.H04.1.454.heavy.3.raw
  modified_base (326)..(326): a, c, t, g, unknown or other
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttntctaatgtcacaagatacacacagagattccagggcagaatcacacttaccgcggacaaatccacgggcacagcgcagttggacctgagcggcctgagacctgaggacacggccatttactactgtgtgcggggaggtggacggagctcggtttcggagttatcatctactacttgaattc

SEQ ID NO: 449608 - DNA, 500 bp, Homo sapiens
  misc_feature: HEFZJCU01DUK10.52.85.H08.1.454.heavy.3.raw
cgcagtacgacacgaccggtgctcgatttagtatcactcagtcgcggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccatcgttttagactcctggggccagggaaccctggtctccgt

SEQ ID NO: 449609 - DNA, 466 bp, Homo sapiens
  misc_feature: HEFZJCU01BG5JA.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggaacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 449610 - DNA, 505 bp, Homo sapiens; identical to SEQ ID NO: 445664
  misc_feature: HEFZJCU01EF590.12.33.C11.1.454.heavy.3.raw

SEQ ID NO: 449611 - DNA, 519 bp, Homo sapiens
  misc_feature: HEFZJCU01DFPSL.22.28.C06.1.454.heavy.3.raw
acatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgcaacccctccctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctgggccagggaaccctggtcaccgtctcctcagcctccaccaagggcccactcggtcttccccctggccaccctcctccaagagcacctctggggcac

SEQ ID NO: 449612 - DNA, 534 bp, Homo sapiens
  misc_feature: HEFZJCU01AELRE.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggaggggctttcatgtctgggccaagggacgctggtcaccgtctcttcagcctccaccaagggcccatcggtcttcccctggcaccctcctccaagagcacctctgggggcacagcc

SEQ ID NO: 449613 - DNA, 501 bp, Homo sapiens; identical to SEQ ID NO: 447719
  misc_feature: HEFZJCU01DGL2Z.17.10.A10.1.454.heavy.3.raw

SEQ ID NO: 449614 - DNA, 525 bp, Homo sapiens; identical to SEQ ID NO: 445545
  misc_feature: HEFZJCU01EI3RL.12.86.H09.1.454.heavy.3.raw

SEQ ID NO: 449615 - DNA, 510 bp, Homo sapiens; identical to SEQ ID NO: 448617
  misc_feature: HEFZJCU01CN0U4.9.12.B01.1.454.heavy.3.raw

SEQ ID NO: 449616 - DNA, 534 bp, Homo sapiens
  misc_feature: HEFZJCU01EQUWZ.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattacaaaagcacgctgtatctgcaaatgaacagcctgagaaccgaggacacagccgtgtattactgtaccacactcccctagaagcgtcaactactactactacggtatggacctcg

SEQ ID NO: 449617 - DNA, 532 bp, Homo sapiens
  misc_feature: HEFZJCU01CHH7W.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggttttccgttgttaggctatttacaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccg

SEQ ID NO: 449618 - DNA, 379 bp, Homo sapiens; identical to SEQ ID NO: 444450
  misc_feature: HEFZJCU01BOGYO.47.77.G11.1.454.heavy.3.raw

SEQ ID NO: 449619 - DNA, 517 bp, Homo sapiens
  misc_feature: HEFZJCU01DDYS8.9.34.D01.1.454.heavy.3.raw
tgatacgtctcacgaccggtgctcgatttagatcgtctgtgttgggtttggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 449620 - DNA, 507 bp, Homo sapiens; identical to SEQ ID NO: 446637
  misc_feature: HEFZJCU01EKDTG.16.34.D01.1.454.heavy.3.raw

SEQ ID NO: 449621 - DNA, 512 bp, Homo sapiens
  misc_feature: HEFZJCU01C5GJJ.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttgggccggggaacctggtcaccgtcaa

SEQ ID NO: 449622 - DNA, 423 bp, Homo sapiens
  misc_feature: HEFZJCU01EGCPB.51.68.G02.1.454.heavy.3.raw
cgatcgtatacacgaccggtgctcgatttagtcgatagtgaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 449623 - DNA, 320 bp, Homo sapiens; identical to SEQ ID NO: 445022
  misc_feature: HEFZJCU01DL7HW.14.28.C06.1.454.heavy.3.raw

SEQ ID NO: 449624 - DNA, 528 bp, Homo sapiens
  misc_feature: HEFZJCU01D969U.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccagggaaccctggtcaccgtctcctcagcctccaaccg

SEQ ID NO: 449625 - DNA, 507 bp, Homo sapiens
  misc_feature: HEFZJCU01B2XS8.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccaggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctggggcacagcggccctggctgcctgtcaaggactac

SEQ ID NO: 449626 - DNA, 500 bp, Homo sapiens; identical to SEQ ID NO: 445080
  misc_feature: HEFZJCU01CWOLB.3.81.H04.1.454.heavy.3.raw

SEQ ID NO: 449627 - DNA, 501 bp, Homo sapiens
  misc_feature: HEFZJCU01CJILF.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttccccctggccgccctgcctccaggagcacctccgagagcacagcggccctgggctgcctggtcaaggactaccg

SEQ ID NO: 449628 - DNA, 471 bp, Homo sapiens
  misc_feature: HEFZJCU01ETUS5.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagagg

SEQ ID NO: 449629 - DNA, 522 bp, Homo sapiens; identical to SEQ ID NO: 446788
  misc_feature: HEFZJCU01DFLH4.12.40.D07.1.454.heavy.3.raw

SEQ ID NO: 449630 - DNA, 384 bp, Homo sapiens; identical to SEQ ID NO: 444454
  misc_feature: HEFZJCU01BGEG0.11.61.F06.1.454.heavy.3.raw

SEQ ID NO: 449631 - DNA, 509 bp, Homo sapiens
  misc_feature: HEFZJCU01EIAC2.12.14.B03.1.454.heavy.3.raw
atacgacgtacacgaccggtgctcgatttagtgtgagtagtttgagtttgggggaggcttggtacagcctggggggtccctgagactctcctgtgaagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagctgccctgggctgcctggtcaaggactacttcctacgtcgtat

SEQ ID NO: 449632 - DNA, 522 bp, Homo sapiens
  misc_feature: HEFZJCU01AI9YZ.40.9.A09.1.454.heavy.3.raw
tctagcgactcacgaccggtgctcgatttagcgagacgcgcagggacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcactcggggcggtgactttgactactggggccagggcaccctggtcaccgtctcctcacgcctccaccaagggcccatcggtcttccccctggccgccctcgcagga

SEQ ID NO: 449633 - DNA, 450 bp, Homo sapiens; identical to SEQ ID NO: 444890
  misc_feature: HEFZJCU01BGBAM.9.53.E09.1.454.heavy.3.raw

SEQ ID NO: 449634 - DNA, 519 bp, Homo sapiens
  misc_feature: HEFZJCU01DDD2Y.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggacccccccccccccttatctcatctgatggaagagatgcctattacgcagactccgtgaagggccgattcaccatctccagagacaattccaagaacacactgtatctgcaaataggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgccc

SEQ ID NO: 449635 - DNA, 492 bp, Homo sapiens
  misc_feature: HEFZJCU01C0JHM.51.38.D05.1.454.heavy.3.raw
cgatcgtatacacgaccggtgctcgatttagtatctgatagtgggtttgggctcaactctcttgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggtcatcgtctcttcggcctccaccaagggcccatcggtcttcccctggccaccctcctccaagagcacctcgg

SEQ ID NO: 449636 - DNA, 504 bp, Homo sapiens
  misc_feature: HEFZJCU01CD27Y.48.44.D11.1.454.heavy.3.raw
agtatacatacacgaccggtgctcgatttagcgcagtacgaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttgccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 449637 - DNA, 510 bp, Homo sapiens; identical to SEQ ID NO: 448445
  misc_feature: HEFZJCU01CNDHQ.16.71.G05.1.454.heavy.3.raw

SEQ ID NO: 449638 - DNA, 481 bp, Homo sapiens
  misc_feature: HEFZJCU01B6154.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctattattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 449639 - DNA, 511 bp, Homo sapiens
  misc_feature: HEFZJCU01DGOL5.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctcaggagcacctcgagagcacagcggccctggctcg

SEQ ID NO: 449640 - DNA, 481 bp, Homo sapiens
  misc_feature: HEFZJCU01DYOS8.48.38.D05.1.454.heavy.3.raw
agtatacatacacgaccggtgctcgatttagtatctgatagttgggtttggggatcacagaacaaccacactcctcctctaaacgaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtatcgtccttcttcaactagaacgcactacgcacagaagttcgaggacagagtcacatttatggtggataaagccacgagcacagtctacatgcagctgagcagcctgagacacaacgactacggcgtctattattgttccagagataatcgcgtgaataagat

SEQ ID NO: 449641 - DNA, 500 bp, Homo sapiens; identical to SEQ ID NO: 447806
  misc_feature: HEFZJCU01CF528.48.34.D01.1.454.heavy.3.raw

SEQ ID NO: 449642 - DNA, 486 bp, Homo sapiens
  misc_feature: HEFZJCU01CI22Q.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggccatcggtcttcccctggcgccctgctccaggagcacctccgagagcacagcggccctgggctgcctggtcagactacttcgtatctctcg

SEQ ID NO: 449643 - DNA, 511 bp, Homo sapiens
  misc_feature: HEFZJCU01D13SQ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaaggccc

SEQ ID NO: 449644 - DNA, 507 bp, Homo sapiens
  misc_feature: HEFZJCU01CQ5VN.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcgtcttcccctggcgccctgctccaggagcacctccgagagcacagcggccctgggctgcctggtcaaggactacttccagacgtatca

SEQ ID NO: 449645 - DNA, 510 bp, Homo sapiens
  misc_feature: HEFZJCU01D8VCM.10.71.G05.1.454.heavy.3.raw
catagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtcttccg

SEQ ID NO: 449646 - DNA, 489 bp, Homo sapiens
  misc_feature: HEFZJCU01DC64H.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggcctgggctgcctggtcaaggactacttcccatacctcgta

SEQ ID NO: 449647 - DNA, 488 bp, Homo sapiens; identical to SEQ ID NO: 447495
  misc_feature: HEFZJCU01D2XC5.22.86.H09.1.454.heavy.3.raw

SEQ ID NO: 449648 - DNA, 484 bp, Homo sapiens
  misc_feature: HEFZJCU01A7HDD.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagccgccgtggctcgcgtggtacgaaggactaccttactacgacacg

SEQ ID NO: 449649 - DNA, 324 bp, Homo sapiens; identical to SEQ ID NO: 444475
  misc_feature: HEFZJCU01DLAN8.18.17.B06.1.454.heavy.3.raw

SEQ ID NO: 449650 - DNA, 395 bp, Homo sapiens; identical to SEQ ID NO: 444517
  misc_feature: HEFZJCU01EDGRN.16.68.G02.1.454.heavy.3.raw

SEQ ID NO: 449651 - DNA, 392 bp, Homo sapiens; identical to SEQ ID NO: 444682
  misc_feature: HEFZJCU01CX7Q5.16.70.G04.1.454.heavy.3.raw

SEQ ID NO: 449652 - DNA, 467 bp, Homo sapiens
  misc_feature: HEFZJCU01BEL2Z.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacgactgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 449653 - DNA, 403 bp, Homo sapiens
  misc_feature: HEFZJCU01B9GO5.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtcgtattattgtgcgagagggggcacctcggtccgcttattactaccactcctacttggacgtctggggcaaagggaccgcggtcaccgtctcctcagcctccaccaagggcccatcggtcttccccctggcgccctgctccaggagcacctccgagagcgacagcggccctgggctgcctggtcaaggactacttcctacgtgagct

SEQ ID NO: 449654 - DNA, 507 bp, Homo sapiens; identical to SEQ ID NO: 445401
  misc_feature: HEFZJCU01BQXF4.22.86.H09.1.454.heavy.3.raw

SEQ ID NO: 449655 - DNA, 498 bp, Homo sapiens
  misc_feature: HEFZJCU01ANFJP.48.34.D01.1.454.heavy.3.raw
agtatacatacacgaccggtgctcgatttagatcgtctgtgttgggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 449656 - DNA, 377 bp, Homo sapiens
  misc_feature: HEFZJCU01CRW1T.19.17.B06.1.454.heavy.3.raw
tactctcgtgcacgaccggtgctcgatttagtcgatagtgaaggggctggaatggcttgcatcccttggttggagtggaattaatacacaccacgcagactcagtgaggggccggttcaccatctccagagacaacgccaagagtacaatgtatttacaaatgaacagcctgagagccgaggatacggctgtgtattattgtgcgagaatttccgagccgcactactttgactactggggccagggagccctggtcaccgtctcctcagcctccaccaagggcccatcggtcttccccctggcgccctgctccaggagcacctccgagagcacagcggccctgggctgcctggtcaaggactacttccacgagagta

SEQ ID NO: 449657 - DNA, 543 bp, Homo sapiens
  misc_feature: HEFZJCU01CJCOM.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggttggagtcggggagtttggttcctgggggccaggggaacctggtcaccg

SEQ ID NO: 449658 - DNA, 492 bp, Homo sapiens
  misc_feature: HEFZJCU01A8SVU.52.53.E09.1.454.heavy.3.raw
cgcagtacgacacgaccggtgctcgatttagagagagtgtgttgggtttggggaggcttggtccagcctggtggttccctgagactctcctgtgcagcctctggatttccgtcagtagcaactacatgagctgggtccgccaggctccagggaagggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaattctggggccagggaacccggtcaccgtctcctcagccctccaccaagggcccatccggtcttccccctggccaccctcctccaagagcacctctgggggcacagcggccctgggctgcctggtcaaggactacttcctatacgatcg

SEQ ID NO: 449659 - DNA, 481 bp, Homo sapiens; identical to SEQ ID NO: 445517
  misc_feature: HEFZJCU01DJRU3.22.36.D03.1.454.heavy.3.raw

SEQ ID NO: 449660 - DNA, 516 bp, Homo sapiens
  misc_feature: HEFZJCU01EUJYI.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgaccctgggccagggaaccctggtcaccgtctcctcagcctccaccaaggcccatcggtcttcccctggcaccctcctccaagagcacctctggggcacagcggccctgggctgcctggtcaaggactacttccgagtagtacacg

SEQ ID NO: 449661 - DNA, 500 bp, Homo sapiens
  misc_feature: HEFZJCU01B1FTD.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggcttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtcatcgtacaatttgataggctctatggtactggacttc

SEQ ID NO: 449662 - DNA, 478 bp, Homo sapiens
  misc_feature: HEFZJCU01DYIL7.12.81.H04.1.454.heavy.3.raw
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttccccctggcgccctgctccaggagcacctcccgagagcacagcggccctgggctgcctggtcaaggactacttcctacgtcgtat

SEQ ID NO: 449663 - DNA, 503 bp, Homo sapiens
  misc_feature: HEFZJCU01CI5KJ.49.80.H03.1.454.heavy.3.raw
  modified_base (449)..(449): a, c, t, g, unknown or other
agtcgagagacacgaccggtgctcgatttagctgtgcgtcgaaggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaaaaagngcacctcgtgggggcacagcggccctgggctgcctggtcaggactacttcctct

SEQ ID NO: 449664 - DNA, 522 bp, Homo sapiens
  misc_feature: HEFZJCU01BTVS5.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacacgg

SEQ ID NO: 449665 - DNA, 543 bp, Homo sapiens; identical to SEQ ID NO: 446584
  misc_feature: HEFZJCU01BXUOC.16.39.D06.1.454.heavy.3.raw

SEQ ID NO: 449666 - DNA, 392 bp, Homo sapiens; identical to SEQ ID NO: 444626
  misc_feature: HEFZJCU01BMCFF.49.46.E02.1.454.heavy.3.raw

SEQ ID NO: 449667 - DNA, 520 bp, Homo sapiens
  misc_feature: HEFZJCU01C0Z3T.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattacaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttatactgtgcgagagattcgagtggttcggggacctcaccctggtctacttcgatctctgggccgt

SEQ ID NO: 449668 - DNA, 518 bp, Homo sapiens
  misc_feature: HEFZJCU01CT8GX.2.15.B04.1.454.heavy.3.raw
acgctcgacacacgaccggtgctcgatttagacagtatatatccgcgggggggagaggagccccagccctgagattcccaggtgtttccattcggtgatcagcactgaacacagagaacgcaccatggagtttggactgaactgggttttccttgttgctattttaaaaggtgtccagtgtgaggtgcagctggtggagtctgggggaggcttggtacagcctggggggtccctgcgactctcctgtgcagcctctggattcacctttgatgattataacattcactgggtccgtcaagctccggggaaggtctggagtgggtctctgttattacttgggatggagcaactacatactatgcagactctgtgcagggccgattcaccacctccagagacaataccagaaactccctatatctgcaaatgaacagtctgagcgctgaggacaccgccttgtattactgtgcaaaagggatggcggacgaccgctattactactccggtctggaccgtcg

SEQ ID NO: 449669 - DNA, 516 bp, Homo sapiens
  misc_feature: HEFZJCU01B4NM7.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctcggcgccctcgctccaggagcacc

SEQ ID NO: 449670 - DNA, 526 bp, Homo sapiens
  misc_feature: HEFZJCU01BC6Q4.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccgacaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctggggcacagcggccctgggctg

SEQ ID NO: 449671 - DNA, 506 bp, Homo sapiens; identical to SEQ ID NO: 444696
  misc_feature: HEFZJCU01AIUC9.16.34.D01.1.454.heavy.3.raw

SEQ ID NO: 449672 - DNA, 395 bp, Homo sapiens
  misc_feature: HEFZJCU01C1RWI.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaagactacttcctacgtgagct

SEQ ID NO: 449673 - DNA, 498 bp, Homo sapiens
  misc_feature: HEFZJCU01B8YYI.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtc

SEQ ID NO: 449674 - DNA, 479 bp, Homo sapiens
  misc_feature: HEFZJCU01CBPIX.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttcagacgtatca

SEQ ID NO: 449675 - DNA, 522 bp, Homo sapiens
  misc_feature: HEFZJCU01CK60C.8.25.C03.1.454.heavy.3.raw
ctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctgggccagggaaccctggtcaccgtctcctcagcctccaccaagggcccatcggtcttcccctggcgccctgctccaggagccacctccgagagcacagcggccctgggctg

SEQ ID NO: 449676 - DNA, 490 bp, Homo sapiens; identical to SEQ ID NO: 444500
  misc_feature: HEFZJCU01DVIDR.19.53.E09.1.454.heavy.3.raw

SEQ ID NO: 449677 - DNA, 501 bp, Homo sapiens
  misc_feature: HEFZJCU01EHX29.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagatttcctggggccagggaagcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 449678 - DNA, 432 bp, Homo sapiens
  misc_feature: HEFZJCU01DH3GI.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgttaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 449679 - DNA, 387 bp, Homo sapiens
  misc_feature: HEFZJCU01A8WRY.19.86.H09.1.454.heavy.3.raw
tactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 449680 - DNA, 327 bp, Homo sapiens; identical to SEQ ID NO: 444439
  misc_feature: HEFZJCU01CMLTY.40.20.B09.1.454.heavy.3.raw

SEQ ID NO: 449681 - DNA, 409 bp, Homo sapiens
  misc_feature: HEFZJCU01D6MF3.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaattggacagcctgagagccgacgacacggccgtatattactgtgccagaaagtccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 449682 - DNA, 491 bp, Homo sapiens; identical to SEQ ID NO: 445333
  misc_feature: HEFZJCU01ALHEU.19.53.E09.1.454.heavy.3.raw

SEQ ID NO: 449683 - DNA, 520 bp, Homo sapiens
  misc_feature: HEFZJCU01BVV9H.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggtaggtggagtatttaa

SEQ ID NO: 449684 - DNA, 490 bp, Homo sapiens
  misc_feature: HEFZJCU01EADJH.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggccctgggctgcctggtcaaggactacttcctacagtgct

SEQ ID NO: 449685 - DNA, 400 bp, Homo sapiens; identical to SEQ ID NO: 444452
  misc_feature: HEFZJCU01DW7F7.47.24.C02.1.454.heavy.3.raw

SEQ ID NO: 449686 - DNA, 493 bp, Homo sapiens
  misc_feature: HEFZJCU01CSGPL.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtccttcccctggccgccctgcctccaggagcacctccgagagcacagcggccctgggctgcctggtcaaggactactcccacgagagta

SEQ ID NO: 449687 - DNA, 506 bp, Homo sapiens
  misc_feature: HEFZJCU01D05QJ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctcaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccagagcacctctggggcacagcggccctgggctgcctggtcaggactactccatac

SEQ ID NO: 449688 - DNA, 491 bp, Homo sapiens; identical to SEQ ID NO: 444592
  misc_feature: HEFZJCU01AJO7C.11.26.C04.1.454.heavy.3.raw

SEQ ID NO: 449689 - DNA, 479 bp, Homo sapiens; identical to SEQ ID NO: 447128
  misc_feature: HEFZJCU01AXUK2.4.37.D04.1.454.heavy.3.raw

SEQ ID NO: 449690 - DNA, 508 bp, Homo sapiens
  misc_feature: HEFZJCU01C6FIY.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccgagggaaggggctggaatgggtctcaggtattactggtggtggttataccacatactacgcagactccgtgaagggccggttcaccatctccagagacaattccaagaacacactgtatctgacaaatgaacagcctgagacgccgacgaccacggccatatattactgtgacgaaagcaaccggcagttagtcacccatacctactttgactt

SEQ ID NO: 449691 - DNA, 498 bp, Homo sapiens
  misc_feature: HEFZJCU01CWROL.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaagggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtgacccctgactgataaaccggactggttcgacccctggggccagggaaccctggtcaccgtctcctc

SEQ ID NO: 449692 - DNA, 513 bp, Homo sapiens
  misc_feature: HEFZJCU01EVIYR.2.53.E09.1.454.heavy.3.raw
acgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcggacgccttttgactacgtggggccagggaaccctggtcaccgtctcctcagcctccaccaacgggccc

SEQ ID NO: 449693 - DNA, 505 bp, Homo sapiens
  misc_feature: HEFZJCU01EQO7B.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaaggggaccacggtcatcgtctccccagcctccaccaagggcccatcggtcttcccctggcgccctgctcc

SEQ ID NO: 449694 - DNA, 515 bp, Homo sapiens
  misc_feature: HEFZJCU01CUDLL.11.26.C04.1.454.heavy.3.raw
  modified_base (496)..(496): a, c, t, g, unknown or other
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcctgggctgcctggtcaaggactacttccgtatctctctcgctgngggcggcgtcgagacggcg

SEQ ID NO: 449695 - DNA, 522 bp, Homo sapiens
  misc_feature: HEFZJCU01CLPD7.12.40.D07.1.454.heavy.3.raw
  modified_base (487)..(487): a, c, t, g, unknown or other
atacgacgtacacgaccggtgctcgatttagtgatagagcgtaacaacagaggggctcaccatggagtttgggctgagcgtgggttttcctcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggaccctggtcatcgtctcccngcctccaccaagggcccatcggtcttcccctggcg

SEQ ID NO: 449696 - DNA, 500 bp, Homo sapiens; identical to SEQ ID NO: 445720
  misc_feature: HEFZJCU01A8PGM.3.20.B09.1.454.heavy.3.raw

SEQ ID NO: 449697 - DNA, 503 bp, Homo sapiens
  misc_feature: HEFZJCU01DPBGF.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttcccctggcgccctgctccaggagcacctccgagagcacagcggccctgggctgcctggtcaaggactacttccactactatg

SEQ ID NO: 449698 - DNA, 497 bp, Homo sapiens
  misc_feature: HEFZJCU01DE1CC.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaaatgatagaaatcagggatgggggccagggaaccctggtcaccgtctcctcagcctccaccaagggccatcggtcttccctggcgcctgctccaggagcacctccgagagcacagcggccctgggctgcctggtcaaggactactccga

SEQ ID NO: 449699 - DNA, 481 bp, Homo sapiens; identical to SEQ ID NO: 446362
  misc_feature: HEFZJCU01EWXTZ.19.67.G01.1.454.heavy.3.raw

SEQ ID NO: 449700 - DNA, 503 bp, Homo sapiens
  misc_feature: HEFZJCU01DMBL8.9.33.C11.1.454.heavy.3.raw
tgatacgtctcacgaccggtgctcgatttagagtgagctcgttgggtttgtggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctgggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 449701 - DNA, 508 bp, Homo sapiens; identical to SEQ ID NO: 448191
  misc_feature: HEFZJCU01DQ5SU.4.67.G01.1.454.heavy.3.raw

SEQ ID NO: 449702 - DNA, 522 bp, Homo sapiens; identical to SEQ ID NO: 446788
  misc_feature: HEFZJCU01CFDL4.12.40.D07.1.454.heavy.3.raw

SEQ ID NO: 449703 - DNA, 483 bp, Homo sapiens; identical to SEQ ID NO: 444639
  misc_feature: HEFZJCU01DVCOX.11.23.C01.1.454.heavy.3.raw

SEQ ID NO: 449704 - DNA, 384 bp, Homo sapiens; identical to SEQ ID NO: 446967
  misc_feature: HEFZJCU01D1IUK.13.42.D09.1.454.heavy.3.raw

SEQ ID NO: 449705 - DNA, 510 bp, Homo sapiens; identical to SEQ ID NO: 445542
  misc_feature: HEFZJCU01DBFD8.16.21.B10.1.454.heavy.3.raw

SEQ ID NO: 449706 - DNA, 384 bp, Homo sapiens; identical to SEQ ID NO: 444454
  misc_feature: HEFZJCU01EUDV4.11.61.F06.1.454.heavy.3.raw

SEQ ID NO: 449707 - DNA, 482 bp, Homo sapiens
  misc_feature: HEFZJCU01EDRF1.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctcgtgggggcacagcggccctgggctgcctggtcaaggactacttcctagagcacg

SEQ ID NO: 449708 - DNA, 519 bp, Homo sapiens; identical to SEQ ID NO: 445330
  misc_feature: HEFZJCU01EGPID.7.78.H01.1.454.heavy.3.raw

SEQ ID NO: 449709 - DNA, 495 bp, Homo sapiens
  misc_feature: HEFZJCU01BY8DJ.40.68.G02.1.454.heavy.3.raw
tctagcgactcacgaccggtgctcgatttagtcgatagtgaagggaaaggggagggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcttgatatgtgggcagggacat

SEQ ID NO: 449710 - DNA, 515 bp, Homo sapiens
  misc_feature: HEFZJCU01ED75Q.48.28.C06.1.454.heavy.3.raw
agtatacatacacgaccggtgctcgatttagagctcacgtattgggtttggggacccaaaaaccacacccctccttgggagaatcccctagatcacagctcctcaccatggactggacctggagcatccttttcttggtggcagcagcaacaggtgcccactcccaggttcgggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtcgtccgacccagcaacgtggttcgtacccc

SEQ ID NO: 449711 - DNA, 506 bp, Homo sapiens; identical to SEQ ID NO: 444732
  misc_feature: HEFZJCU01CVVMG.14.78.H01.1.454.heavy.3.raw

SEQ ID NO: 449712 - DNA, 467 bp, Homo sapiens
  misc_feature: HEFZJCU01CF6A7.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggcctgcctggtcaaggactacttcccacgagagta

SEQ ID NO: 449713 - DNA, 510 bp, Homo sapiens
  misc_feature: HEFZJCU01C4QNM.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttccccctggcaccctcctccaagagcacctctggggcgacagcggccctgggctgcc

SEQ ID NO: 449714 - DNA, 518 bp, Homo sapiens
  misc_feature: HEFZJCU01BWOBS.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctgggccagggaacccaggtcaccgtctcctcagcctccaccaagggccccatccgtcttccccctggcgccctgctccagagcacctccgagagcacagcggcctgggctgcctggtcaggactacttcctacg

SEQ ID NO: 449715 - DNA, 373 bp, Homo sapiens; identical to SEQ ID NO: 445918
  misc_feature: HEFZJCU01BKNOG.49.30.C08.1.454.heavy.3.raw

SEQ ID NO: 449716 - DNA, 482 bp, Homo sapiens; identical to SEQ ID NO: 444503
  misc_feature: HEFZJCU01D7W5S.7.10.A10.1.454.heavy.3.raw

SEQ ID NO: 449717 - DNA, 522 bp, Homo sapiens
  misc_feature: HEFZJCU01CORXT.51.10.A10.1.454.heavy.3.raw
cgatcgtatacacgaccggtgctcgatttagcgtcgatctcaggggtctctgagagaggagcccagcccttggattttcaggtgttttcatttggtgatcaggactggacagagagaactcaccatggtttttgggctgagctggttttttcttgtggctattttaaaaggtgtccagtgtgacatgcaactgttggagtctgggggcggcttggttcagccgggggggtccctcagactctcctgttcaacctctggattcacctttagtggctatgccatgagttgggtccgccaggctccagggaaggggctagagtgggtctcaactattaccagtggtggtggaggcagatactattcagactccgtgaggggccggttcaccgtctccagagacaattccaacaacactgtgtctctgctaatgagcagcctgagagccgacgacacggccgtatattactgtgcgaaagatctccgggggcagttcttcgtggatgcgacctctttttctactat

SEQ ID NO: 449718 - DNA, 502 bp, Homo sapiens
  misc_feature: HEFZJCU01ES1YW.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggccgccctgctccaggagcacctccgagagcacagcggcccgtgggctgcctggtcaaggactacttcctacgtcgtat

SEQ ID NO: 449719 - DNA, 315 bp, Homo sapiens; identical to SEQ ID NO: 444763
  misc_feature: HEFZJCU01DE0NC.47.56.F01.1.454.heavy.3.raw

SEQ ID NO: 449720 - DNA, 508 bp, Homo sapiens; identical to SEQ ID NO: 446002
  misc_feature: HEFZJCU01ER44F.9.78.H01.1.454.heavy.3.raw

SEQ ID NO: 449721 - DNA, 517 bp, Homo sapiens
  misc_feature: HEFZJCU01DWPY6.52.52.E08.1.454.heavy.3.raw
cgcagtacgacacgaccggtgctcgatttagtcgagctctcagagagaaaggggatactttctgagactcatggacctcctgcacaagaacatgagacacctgtggttcttcctcctcctggtggcagctcccagatgggtcctgtctcaggtgcagctgcaggagtcgggcccaggactggtgaagccttcggggaccctgtctctcacctgcgctgtctctggtgggtccatcagaagtagtaactggtggagttgggtccgccagcccccagggaagggtctggagtggattggggaaatctatcatactgggaacaccaactacagcccgtccctcaagagtcgagtcgccatatcactagaccaggcgaacaacgagttctccctgaaactgagctctgtgaccgccgcagacacggccgtgtattattgtgggagagatcggagagatagtagtggtttttactacggtgactacgacggtatggacgtctggggccaagggaccacggtc

SEQ ID NO: 449722 - DNA, 488 bp, Homo sapiens
  misc_feature: HEFZJCU01AHEMB.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctctgggggcacagcggccctgggctgcctggtcaaggactactcctacgtgagct

SEQ ID NO: 449723 - DNA, 482 bp, Homo sapiens; identical to SEQ ID NO: 444503
  misc_feature: HEFZJCU01D79UA.7.10.A10.1.454.heavy.3.raw

SEQ ID NO: 449724 - DNA, 509 bp, Homo sapiens
  misc_feature: HEFZJCU01AO12E.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggttcgacccctggggccagggaaccctggtcaccgtctcctcagcctccaccaaggcccatcggtcttcccctggcaccctcctccaagagcacctctgggggcacagcggccctgggctgcctggtcaaggactacttcctacgtcgtat

SEQ ID NO: 449725 - DNA, 500 bp, Homo sapiens; identical to SEQ ID NO: 444864
  misc_feature: HEFZJCU01C2XMN.9.30.C08.1.454.heavy.3.raw

SEQ ID NO: 449726 - DNA, 519 bp, Homo sapiens; identical to SEQ ID NO: 444867
  misc_feature: HEFZJCU01ETPJ2.9.34.D01.1.454.heavy.3.raw

SEQ ID NO: 449727 - DNA, 537 bp, Homo sapiens
  misc_feature: HEFZJCU01CIZL2.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccgggggggtccctgagactctcctgtgcagcctctggattcaatttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggctggatcggggagtttggtcctggggccagggaaccctggtcc

SEQ ID NO: 449728 - DNA, 537 bp, Homo sapiens
  misc_feature: HEFZJCU01EYU6M.13.38.D05.1.454.heavy.3.raw
tcacgtactacacgaccggtgctcgatttagtatctgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactacgtggggcccgggacg

SEQ ID NO: 449729 - DNA, 370 bp, Homo sapiens; identical to SEQ ID NO: 446460
  misc_feature: HEFZJCU01D0ATZ.14.77.G11.1.454.heavy.3.raw

SEQ ID NO: 449730 - DNA, 519 bp, Homo sapiens; identical to SEQ ID NO: 444867
  misc_feature: HEFZJCU01B58QD.9.34.D01.1.454.heavy.3.raw

SEQ ID NO: 449731 - DNA, 491 bp, Homo sapiens; identical to SEQ ID NO: 444592
  misc_feature: HEFZJCU01B7AQP.11.26.C04.1.454.heavy.3.raw

SEQ ID NO: 449732 - DNA, 484 bp, Homo sapiens; identical to SEQ ID NO: 445876
  misc_feature: HEFZJCU01DGU31.8.39.D06.1.454.heavy.3.raw

SEQ ID NO: 449733 - DNA, 466 bp, Homo sapiens; identical to SEQ ID NO: 447638
  misc_feature: HEFZJCU01DWJHX.19.10.A10.1.454.heavy.3.raw

SEQ ID NO: 449734 - DNA, 339 bp, Homo sapiens; identical to SEQ ID NO: 444436
  misc_feature: HEFZJCU01C32JL.47.38.D05.1.454.heavy.3.raw

SEQ ID NO: 449735 - DNA, 523 bp, Homo sapiens
  misc_feature: HEFZJCU01BS88G.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagccggccctgggctgcctggtacaaggactacttcctacg

SEQ ID NO: 449736 - DNA, 477 bp, Homo sapiens; identical to SEQ ID NO: 444659
  misc_feature: HEFZJCU01B98GH.16.10.A10.1.454.heavy.3.raw

SEQ ID NO: 449737 - DNA, 521 bp, Homo sapiens
  misc_feature: HEFZJCU01C9LGC.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcagggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 449738 - DNA, 524 bp, Homo sapiens; identical to SEQ ID NO: 445902
  misc_feature: HEFZJCU01BYYF4.9.78.H01.1.454.heavy.3.raw

SEQ ID NO: 449739 - DNA, 532 bp, Homo sapiens
  misc_feature: HEFZJCU01DZG7B.16.87.H10.1.454.heavy.3.raw
tgtactactccacgaccggtgctcgatttagcagtactgcgttgggtttggggcccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggaccacggctgtgtattactgtgcaaggcagttcgtaggaaacagttatgggttggggggtagtttgggttttttttcgttacgttacgggat

SEQ ID NO: 449740 - DNA, 531 bp, Homo sapiens
  misc_feature: HEFZJCU01ELO33.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttcgtggggccaggggaccctggtcatcgtctccccagcctccaccaacgggcccatccggtcttcccctggccgccctcg

SEQ ID NO: 449741 - DNA, 519 bp, Homo sapiens
  misc_feature: HEFZJCU01E1NY7.22.43.D10.1.454.heavy.3.raw
acatacgcgtcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctcccagagaccattccaagaacaccctatatcttcaaatgaacaacctgagagtcgaagacacggccgtatattactgtgcgagacatgacttcgtgacccctggggccgagggaaccctcggtcaccgtctcctc

SEQ ID NO: 449742 - DNA, 528 bp, Homo sapiens
  misc_feature: HEFZJCU01DCZQB.48.87.H10.1.454.heavy.3.raw
agtatacatacacgaccggtgctcgatttagcagtactgcgttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgactggggatgcttttcatttctggggccaggggaccgtggtcgccgtgtctacagcctccaccaagggcccatcggtcttccccctggcca

SEQ ID NO: 449743 - DNA, 463 bp, Homo sapiens; identical to SEQ ID NO: 448118
  misc_feature: HEFZJCU01BLF1I.19.10.A10.1.454.heavy.3.raw

SEQ ID NO: 449744 - DNA, 507 bp, Homo sapiens
  misc_feature: HEFZJCU01DJ999.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaaatctgagagtcgacgacacggccacctattattgtgcgcgacatgactacgctcaattctggggccaggggacg

SEQ ID NO: 449745 - DNA, 495 bp, Homo sapiens
  misc_feature: HEFZJCU01BRYDY.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgctacttttc

SEQ ID NO: 449746 - DNA, 521 bp, Homo sapiens; identical to SEQ ID NO: 445317
  misc_feature: HEFZJCU01AR383.12.40.D07.1.454.heavy.3.raw

SEQ ID NO: 449747 - DNA, 545 bp, Homo sapiens
  misc_feature: HEFZJCU01DEEOY.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacgggccctttattactgtgcgaaggatcgcccctataatggtggctggatcgggggagttttgggttcctgggggtccaggggaacccctgggt

SEQ ID NO: 449748 - DNA, 482 bp, Homo sapiens
  misc_feature: HEFZJCU01B9E8D.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatacattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 449749 - DNA, 515 bp, Homo sapiens; identical to SEQ ID NO: 446472
  misc_feature: HEFZJCU01AQJH9.4.57.F02.1.454.heavy.3.raw

SEQ ID NO: 449750 - DNA, 510 bp, Homo sapiens
  misc_feature: HEFZJCU01EN9AN.4.36.D03.1.454.heavy.3.raw
agcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagcaacaaggaaaacccagctcagccccaattccatggtgagtcctctgtgctcagtgctgatcaccaagtggaaaggccttggagtccagggctaaggctcctctctgagacctccaccaagggcccatcggtcttcccctggcgccctgctccaggagcacctccgagagcacagcggccctgggctgcctggtcaaggactacttccctac

SEQ ID NO: 449751 - DNA, 519 bp, Homo sapiens; identical to SEQ ID NO: 446650
  misc_feature: HEFZJCU01DBK77.13.76.G10.1.454.heavy.3.raw

SEQ ID NO: 449752 - DNA, 470 bp, Homo sapiens
  misc_feature: HEFZJCU01CVCYB.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 449753 - DNA, 537 bp, Homo sapiens
  misc_feature: HEFZJCU01DLIU3.52.56.F01.1.454.heavy.3.raw
cgcagtacgacacgaccggtgctcgatttagcagacgtctgaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaattatggacagaagttccagggcagagtcaccatgaccgcggacacatccacgaacacagcctacatggagctgaggagcctaagatctgacgacacggccgtttattactgtgtgagagattttagggacctcggcccttgggggagttagtcgttactttgactactggggccaggggaacccaggtcaccgtct

SEQ ID NO: 449754 - DNA, 495 bp, Homo sapiens; identical to SEQ ID NO: 445359
  misc_feature: HEFZJCU01ECRI0.4.21.B10.1.454.heavy.3.raw

SEQ ID NO: 449755 - DNA, 450 bp, Homo sapiens; identical to SEQ ID NO: 444890
  misc_feature: HEFZJCU01E0CHL.9.53.E09.1.454.heavy.3.raw

SEQ ID NO: 449756 - DNA, 489 bp, Homo sapiens; identical to SEQ ID NO: 444591
  misc_feature: HEFZJCU01AROXP.18.70.G04.1.454.heavy.3.raw

SEQ ID NO: 449757 - DNA, 498 bp, Homo sapiens
  misc_feature: HEFZJCU01D8XEJ.49.59.F04.1.454.heavy.3.raw
agtcgagagacacgaccggtgctcgatttagtacacacacttagggattggggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcaccctcctccaagagcacctctgggggcacagcggccctgggctgcctggtcaaggactactcctctctcgact

SEQ ID NO: 449758 - DNA, 537 bp, Homo sapiens; identical to SEQ ID NO: 445697
  misc_feature: HEFZJCU01BHLNJ.14.57.F02.1.454.heavy.3.raw

SEQ ID NO: 449759 - DNA, 403 bp, Homo sapiens; identical to SEQ ID NO: 445029
  misc_feature: HEFZJCU01AP0U7.10.77.G11.1.454.heavy.3.raw

SEQ ID NO: 449760 - DNA, 387 bp, Homo sapiens
  misc_feature: HEFZJCU01BAUKK.10.60.F05.1.454.heavy.3.raw
catagtagtgcacgaccggtgctcgatttagtacgtcatcagggaaagggcctggagtgggtctcaggtattactcggaatggtggtataataggctatgcggactctgtgaggggccgcttcaccatctccaaggacagcgccaagagatccctctatctgcaaatgaacagtctgagaactgaggacacggcctactactactgtgcaaaagactgattccggcagttacttcttagataactggggccggggaaccctggtcgccgtctcttcagcctccaccaagggcccatcggtcttccccctggcgccctgctccaggagcacctccgagagcacagcggccctgggctgcctggtcaaggactacttcccactactatg

SEQ ID NO: 449761 - DNA, 509 bp, Homo sapiens
  misc_feature: HEFZJCU01BQWKL.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccaggcgggagttccaagtactcctt

SEQ ID NO: 449762 - DNA, 483 bp, Homo sapiens
  misc_feature: HEFZJCU01BWFIW.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacataggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactactatg

SEQ ID NO: 449763 - DNA, 379 bp, Homo sapiens
  misc_feature: HEFZJCU01C82AY.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgcccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 449764 - DNA, 397 bp, Homo sapiens; identical to SEQ ID NO: 446558
  misc_feature: HEFZJCU01B26HH.47.46.E02.1.454.heavy.3.raw

SEQ ID NO: 449765 - DNA, 509 bp, Homo sapiens; identical to SEQ ID NO: 445824
  misc_feature: HEFZJCU01D2CN0.9.14.B03.1.454.heavy.3.raw

SEQ ID NO: 449766 - DNA, 400 bp, Homo sapiens; identical to SEQ ID NO: 444452
  misc_feature: HEFZJCU01D88RM.47.24.C02.1.454.heavy.3.raw

SEQ ID NO: 449767 - DNA, 499 bp, Homo sapiens
  misc_feature: HEFZJCU01C8AB8.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttccccctggccgccctgctccaggagcacctccgagagcacagcggccctgggctgcctggtcaaggactac

SEQ ID NO: 449768 - DNA, 534 bp, Homo sapiens
  misc_feature: HEFZJCU01BHE4J.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccagggagccctggtcaccg

SEQ ID NO: 449769 - DNA, 482 bp, Homo sapiens; identical to SEQ ID NO: 444503
  misc_feature: HEFZJCU01D6FF2.7.10.A10.1.454.heavy.3.raw

SEQ ID NO: 449770 - DNA, 518 bp, Homo sapiens
  misc_feature: HEFZJCU01D4N66.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 449771 - DNA, 400 bp, Homo sapiens; identical to SEQ ID NO: 444452
  misc_feature: HEFZJCU01DGDL3.47.24.C02.1.454.heavy.3.raw

SEQ ID NO: 449772 - DNA, 523 bp, Homo sapiens
  misc_feature: HEFZJCU01BX7KX.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcgggactcctcttgagatctggggccgaggggacaatggtcaccgtctcttcag

SEQ ID NO: 449773 - DNA, 499 bp, Homo sapiens
  misc_feature: HEFZJCU01AUXNB.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggacacttccagacgtatca

SEQ ID NO: 449774 - DNA, 509 bp, Homo sapiens; identical to SEQ ID NO: 445225
  misc_feature: HEFZJCU01CYP7J.9.78.H01.1.454.heavy.3.raw

SEQ ID NO: 449775 - DNA, 507 bp, Homo sapiens
  misc_feature: HEFZJCU01CT1DV.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcgtcttcccctggcgccctgctccaggacg

SEQ ID NO: 449776 - DNA, 449 bp, Homo sapiens; identical to SEQ ID NO: 444589
  misc_feature: HEFZJCU01ALI05.53.57.F02.1.454.heavy.3.raw

SEQ ID NO: 449777 - DNA, 511 bp, Homo sapiens
  misc_feature: HEFZJCU01A3PS6.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 449778 - DNA, 505 bp, Homo sapiens; identical to SEQ ID NO: 444759
  misc_feature: HEFZJCU01EJ7C7.10.38.D05.1.454.heavy.3.raw

SEQ ID NO: 449779 - DNA, 529 bp, Homo sapiens
  misc_feature: HEFZJCU01ED74Q.18.33.C11.1.454.heavy.3.raw
tacgagtatgcacgaccggtgctcgatttagagtgagctcgttgggtttgggggggagaggagcccagcactgggattccgaggtgtttccattcggtgatcaacactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctcccaccctccaccaac

SEQ ID NO: 449780 - DNA, 482 bp, Homo sapiens; identical to SEQ ID NO: 444503
  misc_feature: HEFZJCU01AV3FE.7.10.A10.1.454.heavy.3.raw

SEQ ID NO: 449781 - DNA, 494 bp, Homo sapiens
  misc_feature: HEFZJCU01AUUTR.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaaggcccatcggtcttcccctggcaccctcctccaagagcacctctgggggcacagcggccctgggctgcctggtcaaggactactccgagtagtaca

SEQ ID NO: 449782 - DNA, 467 bp, Homo sapiens; identical to SEQ ID NO: 445159
  misc_feature: HEFZJCU01E1VTG.48.7.A07.1.454.heavy.3.raw

SEQ ID NO: 449783 - DNA, 436 bp, Homo sapiens
  misc_feature: HEFZJCU01DD65M.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactgggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 449784 - DNA, 512 bp, Homo sapiens
  misc_feature: HEFZJCU01BZOZP.4.26.C04.1.454.heavy.3.raw
agcactgtagcacgaccggtgctcgatttagtctagcgactttgggtttggggagctctgagagaggagcccagccctgggattttcaggtgttttcatttggtgatcaggactgaacagagagaactcaccatggagtttgggctgagcgtggcgttttcttaggtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaatgaacagcctgcgagccgacgacacggccgtatattactgtgcgaaatgccttattgcgaccgagcgtagc

SEQ ID NO: 449785 - DNA, 512 bp, Homo sapiens; identical to SEQ ID NO: 448112
  misc_feature: HEFZJCU01CUOSN.48.2.A02.1.454.heavy.3.raw

SEQ ID NO: 449786 - DNA, 392 bp, Homo sapiens
  misc_feature: HEFZJCU01CYYXJ.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctggtctattactgtgtgagaggcgccaccgtggggatggaaacgattttcttgtttgtctggggccagggaaccctggtcaccgtctcctcagcctccaccaagggcccatcggtcttcccctggcgccctgctccaggagcacctccgagagcacagcggccctgggctgcctggtcaaggactacttcctagagacacg

SEQ ID NO: 449787 - DNA, 525 bp, Homo sapiens; identical to SEQ ID NO: 446818
  misc_feature: HEFZJCU01BJ78D.48.4.A04.1.454.heavy.3.raw

SEQ ID NO: 449788 - DNA, 465 bp, Homo sapiens; identical to SEQ ID NO: 444805
  misc_feature: HEFZJCU01EKKQZ.19.10.A10.1.454.heavy.3.raw

SEQ ID NO: 449789 - DNA, 501 bp, Homo sapiens
  misc_feature: HEFZJCU01EXCTB.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaagggttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtcgcccacgcccggcccccttacg

SEQ ID NO: 449790 - DNA, 516 bp, Homo sapiens
  misc_feature: HEFZJCU01EIDSE.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacgggccacatattattgtgcacaccgacgctataccgccagctgggaaatcgacaactggttcgaccctgggccagggaacccttgtcacgtctcctcagcctcaccaagggcctacg

SEQ ID NO: 449791 - DNA, 500 bp, Homo sapiens
  misc_feature: HEFZJCU01BSP0Q.10.85.H08.1.454.heavy.3.raw
  modified_base (438)..(438): a, c, t, g, unknown or other
  modified_base (442)..(442): a, c, t, g, unknown or other
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgngagngagagacgacgctgtattattctgtcgagggaggggacggccgtatagttcggtaccg

SEQ ID NO: 449792 - DNA, 512 bp, Homo sapiens
  misc_feature: HEFZJCU01AZVEE.49.53.E09.1.454.heavy.3.raw
agtcgagagacacgaccggtgctcgatttagagagagtgtgttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaaggcccatcggtcttcccctcggcaccctcctccaagagcacctctgggggcacagcggccctgggctgcctggtcaaggactacttcctctctcgact

SEQ ID NO: 449793 - DNA, 396 bp, Homo sapiens; identical to SEQ ID NO: 444426
  misc_feature: HEFZJCU01EZLP6.18.31.C09.1.454.heavy.3.raw

SEQ ID NO: 449794 - DNA, 526 bp, Homo sapiens
  misc_feature: HEFZJCU01B8M7M.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggttcgaccctggggccagggaaccctggtcaccgtctcctcagcctccaccaagggcccatccggtcttccccctggccaccctcctccaagagcacctcgtgggggcacagcc

SEQ ID NO: 449795 - DNA, 512 bp, Homo sapiens
  misc_feature: HEFZJCU01DS0QR.51.86.H09.1.454.heavy.3.raw
cgatcgtatacacgaccggtgctcgatttagtgctatagacttgggtttgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaactttgatatctggggccacgggacaatggtcaccgtctcttcagcttccaccaagggcccatcggtcttccccctggcgccctcgctccaggagcacctctgggggcgacagcggccctgggctgcctggtcaaggactacttcctcg

SEQ ID NO: 449796 - DNA, 515 bp, Homo sapiens
  misc_feature: HEFZJCU01CKRSM.9.34.D01.1.454.heavy.3.raw
tgatacgtctcacgaccggtgctcgatttagatcgtctgtgttgggtttggggtctgagagaggagcccagccctgggattgtcaggtgttttcatttggtgatcaggactggacagagagaactcaccatggagtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccg

SEQ ID NO: 449797 - DNA, 492 bp, Homo sapiens; identical to SEQ ID NO: 446787
  misc_feature: HEFZJCU01AER5Q.4.7.A07.1.454.heavy.3.raw

SEQ ID NO: 449798 - DNA, 517 bp, Homo sapiens
  misc_feature: HEFZJCU01BGP6I.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggcctggctgcctggtcaaggactactccgagtagtacac

SEQ ID NO: 449799 - DNA, 432 bp, Homo sapiens; identical to SEQ ID NO: 444920
  misc_feature: HEFZJCU01B9T93.11.39.D06.1.454.heavy.3.raw

SEQ ID NO: 449800 - DNA, 477 bp, Homo sapiens
  misc_feature: HEFZJCU01CW7VU.16.71.G05.1.454.heavy.3.raw
tgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctcgtggggcacagcggccctgggctgcctggtcaaggactacttccgagtagtaca

SEQ ID NO: 449801 - DNA, 396 bp, Homo sapiens; identical to SEQ ID NO: 444469
  misc_feature: HEFZJCU01DMIVL.47.46.E02.1.454.heavy.3.raw

SEQ ID NO: 449802 - DNA, 511 bp, Homo sapiens
  misc_feature: HEFZJCU01C9OY1.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaggagggggaaccgagcgggagtccaagtactcttgtacg

SEQ ID NO: 449803 - DNA, 316 bp, Homo sapiens; identical to SEQ ID NO: 444479
  misc_feature: HEFZJCU01C8ABV.47.84.H07.1.454.heavy.3.raw

SEQ ID NO: 449804 - DNA, 527 bp, Homo sapiens; identical to SEQ ID NO: 446775
  misc_feature: HEFZJCU01CJ47U.9.78.H01.1.454.heavy.3.raw

SEQ ID NO: 449805 - DNA, 465 bp, Homo sapiens; identical to SEQ ID NO: 445132
  misc_feature: HEFZJCU01AKEDJ.5.86.H09.1.454.heavy.3.raw

SEQ ID NO: 449806 - DNA, 514 bp, Homo sapiens
  misc_feature: HEFZJCU01CNGL6.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttccccctggccta

SEQ ID NO: 449807 - DNA, 500 bp, Homo sapiens
  misc_feature: HEFZJCU01C7G5T.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgttgggcgggatagcaggcggacc

SEQ ID NO: 449808 - DNA, 524 bp, Homo sapiens
  misc_feature: HEFZJCU01C7NHK.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtgctggtccactaggtttgactacgtggggccaggggaagctttggtcaccgtctcctcagcctccg

SEQ ID NO: 449809 - DNA, 513 bp, Homo sapiens
  misc_feature: HEFZJCU01AEE8D.51.36.D03.1.454.heavy.3.raw
cgatcgtatacacgaccggtgctcgatttagctgcgtcacgatctctcttggggggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaagggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagtcttttgattagttttgggggccaagggcacggaaggtcaccgtctcatcacg

SEQ ID NO: 449810 - DNA, 511 bp, Homo sapiens
  misc_feature: HEFZJCU01D11K4.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagcgtgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccattcatcatctccagagacaacgccgacaactcactgtctctgctgatgagcagcctgagagccgacgacacggctatctattactgtgcgaaactctcattccgttcatctgaatactggggccagggaaccctggtccgccg

SEQ ID NO: 449811 - DNA, 505 bp, Homo sapiens
  misc_feature: HEFZJCU01ASH09.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaaggcccatcggtcttcccctggcaccctcctccaagagcacctctgggggcacagcggccctgggctgcctggtcaaggactactccgta

SEQ ID NO: 449812 - DNA, 384 bp, Homo sapiens; identical to SEQ ID NO: 444454
  misc_feature: HEFZJCU01DEW8Z.11.61.F06.1.454.heavy.3.raw

SEQ ID NO: 449813 - DNA, 507 bp, Homo sapiens; identical to SEQ ID NO: 445781
  misc_feature: HEFZJCU01DV4Y8.48.44.D11.1.454.heavy.3.raw

SEQ ID NO: 449814 - DNA, 485 bp, Homo sapiens
  misc_feature: HEFZJCU01DP65Z.51.6.A06.1.454.heavy.3.raw
cgatcgtatacacgaccggtgctcgatttagatctactgacaggggtgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgtgcgagagggagatcgatcac

SEQ ID NO: 449815 - DNA, 497 bp, Homo sapiens; identical to SEQ ID NO: 445179
  misc_feature: HEFZJCU01D4RQH.12.55.E11.1.454.heavy.3.raw

SEQ ID NO: 449816 - DNA, 500 bp, Homo sapiens; identical to SEQ ID NO: 445720
  misc_feature: HEFZJCU01D5KG9.3.20.B09.1.454.heavy.3.raw

SEQ ID NO: 449817 - DNA, 489 bp, Homo sapiens; identical to SEQ ID NO: 444791
  misc_feature: HEFZJCU01E02NO.47.85.H08.1.454.heavy.3.raw

SEQ ID NO: 449818 - DNA, 511 bp, Homo sapiens; identical to SEQ ID NO: 445268
  misc_feature: HEFZJCU01BOCI4.48.34.D01.1.454.heavy.3.raw

SEQ ID NO: 449819 - DNA, 501 bp, Homo sapiens; identical to SEQ ID NO: 447719
  misc_feature: HEFZJCU01CUOLA.17.10.A10.1.454.heavy.3.raw

SEQ ID NO: 449820 - DNA, 379 bp, Homo sapiens; identical to SEQ ID NO: 444450
  misc_feature: HEFZJCU01D6RHR.47.77.G11.1.454.heavy.3.raw

SEQ ID NO: 449821 - DNA, 479 bp, Homo sapiens
  misc_feature: HEFZJCU01C5C2Y.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaggactacttccagacgtatca

SEQ ID NO: 449822 - DNA, 312 bp, Homo sapiens
  misc_feature: HEFZJCU01AUD5B.49.8.A08.1.454.heavy.3.raw
agtcgagagacacgaccggtgctcgatttagcatactctacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttcccctggcaccctcctccaagagcacctctgggggcacagcggccctgggctgcctggtcaaggactacttcctctctcgact

SEQ ID NO: 449823 - DNA, 498 bp, Homo sapiens
  misc_feature: HEFZJCU01BW1Y6.13.10.A10.1.454.heavy.3.raw
tcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattgggggcggaagggtatagca

SEQ ID NO: 449824 - DNA, 498 bp, Homo sapiens
  misc_feature: HEFZJCU01D04Y8.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggt

SEQ ID NO: 449825 - DNA, 506 bp, Homo sapiens; identical to SEQ ID NO: 446520
  misc_feature: HEFZJCU01ECDX2.10.38.D05.1.454.heavy.3.raw

SEQ ID NO: 449826 - DNA, 479 bp, Homo sapiens
  misc_feature: HEFZJCU01AGMET.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcgccctgggctgcctggtcaaggactacttccagacgtatca

SEQ ID NO: 449827 - DNA, 513 bp, Homo sapiens
  misc_feature: HEFZJCU01DWSSY.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataaccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 449828 - DNA, 493 bp, Homo sapiens
  misc_feature: HEFZJCU01EJ72B.49.28.C06.1.454.heavy.3.raw
agtcgagagacacgaccggtgctcgatttagagctcacgtattgggtttggggctgctcacatgggaaatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcacagtctctggtggctccatcagcaatgatggtcactactggagctggatccgccagctcccagggaagggcctggagtggattggggacatctctaacaatgggggcacccactacaacccgtccctgaagagtcgagttaccatatcagtagacaagtcgaagaagcaattctccctgaagctgaactctgtgactgccgcggacacggccgtgtattactgtgcgagagacctcgcggattactatgatagaagtggttact

SEQ ID NO: 449829 - DNA, 507 bp, Homo sapiens
  misc_feature: HEFZJCU01A1XY7.53.34.D01.1.454.heavy.3.raw
cgcgtatacacacgaccggtgctcgatttagatcgtctgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttg

SEQ ID NO: 449830 - DNA, 453 bp, Homo sapiens
  misc_feature: HEFZJCU01B23KQ.40.57.F02.1.454.heavy.3.raw
tctagcgactcacgaccggtgctcgatttagctcgatatagttgggtttgggattcacgttgcagatgtagggctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaagaaccctctattgtagtggtggaagttgtaactactactttgattcctggggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 449831 - DNA, 445 bp, Homo sapiens; identical to SEQ ID NO: 445213
  misc_feature: HEFZJCU01BZT0S.3.86.H09.1.454.heavy.3.raw

SEQ ID NO: 449832 - DNA, 505 bp, Homo sapiens
  misc_feature: HEFZJCU01EDIXE.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggctacttccgagtagtaca

SEQ ID NO: 449833 - DNA, 521 bp, Homo sapiens
  misc_feature: HEFZJCU01DX5QI.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccaggggacaatggtcaccgtctcttcag

SEQ ID NO: 449834 - DNA, 512 bp, Homo sapiens
  misc_feature: HEFZJCU01BH6L7.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttccccctggcc

SEQ ID NO: 449835 - DNA, 400 bp, Homo sapiens; identical to SEQ ID NO: 444452
  misc_feature: HEFZJCU01B39MT.47.24.C02.1.454.heavy.3.raw

SEQ ID NO: 449836 - DNA, 506 bp, Homo sapiens; identical to SEQ ID NO: 444696
  misc_feature: HEFZJCU01AKQ5J.16.34.D01.1.454.heavy.3.raw

SEQ ID NO: 449837 - DNA, 501 bp, Homo sapiens
  misc_feature: HEFZJCU01B00AB.49.80.H03.1.454.heavy.3.raw
agtcgagagacacgaccggtgctcgatttagctgtgcgtcgaaggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctct

SEQ ID NO: 449838 - DNA, 419 bp, Homo sapiens
  misc_feature: HEFZJCU01ELKGO.4.46.E02.1.454.heavy.3.raw
agcactgtagcacgaccggtgctcgatttagactcatctacagggaaagggcttgagtggatgggaggctttgatcctgaagatgaagaaaccatctatgcacagaagttccagggcagagtcatcatgaccgaggacacatccacagacacagcctacatggagctccacagtctgagatttgaggacacggccgtttatttctgtacaaccgcctcggcaagccgaacttgtagtggtggtaggtgctactcccatggaacctggttcgactcctggggccagggaaccctggtcagcgtctcctcagcctccaccaagggcccatcggtcttccccctggcaccctcctccaagagcacctctgggggcacagcggccctgggctgcctggtcaaggactacttccctacagtgct

SEQ ID NO: 449839 - DNA, 495 bp, Homo sapiens; identical to SEQ ID NO: 444618
  misc_feature: HEFZJCU01EV53M.3.26.C04.1.454.heavy.3.raw

SEQ ID NO: 449840 - DNA, 505 bp, Homo sapiens
  misc_feature: HEFZJCU01C347B.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagcgtggagtttcctttaggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaacctccctgtatctgcaaatgaacagcctgagagctgaggacacggccttggtattattgtgcaaaagatccaaccccttacgtt

SEQ ID NO: 449841 - DNA, 396 bp, Homo sapiens; identical to SEQ ID NO: 444426
  misc_feature: HEFZJCU01CTE1T.18.31.C09.1.454.heavy.3.raw

SEQ ID NO: 449842 - DNA, 390 bp, Homo sapiens
  misc_feature: HEFZJCU01AX9NI.48.62.F07.1.454.heavy.3.raw
agtatacatacacgaccggtgctcgatttagtagtcgcataaagggaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 449843 - DNA, 534 bp, Homo sapiens
  misc_feature: HEFZJCU01B67YT.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagcgtggagtttccttaggctgctatttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctcgg

SEQ ID NO: 449844 - DNA, 503 bp, Homo sapiens
  misc_feature: HEFZJCU01BZ1D3.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctcgtggggc

SEQ ID NO: 449845 - DNA, 482 bp, Homo sapiens
  misc_feature: HEFZJCU01BZK97.52.8.A08.1.454.heavy.3.raw
cgcagtacgacacgaccggtgctcgatttagcatactctacagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatagaacaggctgagagctgaagacacggctgtatattactgtgcgaacttaatcacgga

SEQ ID NO: 449846 - DNA, 504 bp, Homo sapiens
  misc_feature: HEFZJCU01CKE31.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgactgtatctgaacatgaacagcctgaaaacggaggacacagccgtgtattactgtgccactcaggaccgatatttgtt

SEQ ID NO: 449847 - DNA, 437 bp, Homo sapiens; identical to SEQ ID NO: 444603
  misc_feature: HEFZJCU01ESDU4.3.21.B10.1.454.heavy.3.raw

SEQ ID NO: 449848 - DNA, 449 bp, Homo sapiens
  misc_feature: HEFZJCU01CWEPG.53.57.F02.1.454.heavy.3.raw
cgcgtatacacacgaccggtgctcgatttagctcgatatagttgggtttgggctcgggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 449849 - DNA, 518 bp, Homo sapiens; identical to SEQ ID NO: 449255
  misc_feature: HEFZJCU01BAEIZ.3.17.B06.1.454.heavy.3.raw

SEQ ID NO: 449850 - DNA, 507 bp, Homo sapiens
  misc_feature: HEFZJCU01BJ4OK.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtagacgtggtattccggggggacgacatgactacc

SEQ ID NO: 449851 - DNA, 526 bp, Homo sapiens
  misc_feature: HEFZJCU01CIJS3.8.25.C03.1.454.heavy.3.raw
ctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttcccctggcgccctgctccaggagcacctccgagagcacagcggccctggggctgcct

SEQ ID NO: 449852 - DNA, 383 bp, Homo sapiens; identical to SEQ ID NO: 444673
  misc_feature: HEFZJCU01EQ2GM.11.61.F06.1.454.heavy.3.raw

SEQ ID NO: 449853 - DNA, 384 bp, Homo sapiens; identical to SEQ ID NO: 445503
  misc_feature: HEFZJCU01BJFYK.48.49.E05.1.454.heavy.3.raw

SEQ ID NO: 449854 - DNA, 523 bp, Homo sapiens
  misc_feature: HEFZJCU01B6FS8.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttcccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggccctgggc

SEQ ID NO: 449855 - DNA, 395 bp, Homo sapiens; identical to SEQ ID NO: 447554
  misc_feature: HEFZJCU01C6WL3.18.31.C09.1.454.heavy.3.raw

SEQ ID NO: 449856 - DNA, 517 bp, Homo sapiens
  misc_feature: HEFZJCU01CZ7TO.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaggactacttccagacgtatca

SEQ ID NO: 449857 - DNA, 540 bp, Homo sapiens
  misc_feature: HEFZJCU01BX5HB.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacgacaaattatggacagaagtttccagggcagagtcaccatgaccgcggacacatccacgaacacagcctacatggagctaagtagactgacatctgacgacacggccgtctattattgtgttgagagaggaccccgatgacccttggaaaccatggaacgtctgggggcccagggggacctcggtccaccggtttccctcacg

SEQ ID NO: 449858 - DNA, 514 bp, Homo sapiens
  misc_feature: HEFZJCU01CRCCX.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacagatcactggggccac

SEQ ID NO: 449859 - DNA, 506 bp, Homo sapiens; identical to SEQ ID NO: 445682
  misc_feature: HEFZJCU01CXUCT.48.44.D11.1.454.heavy.3.raw

SEQ ID NO: 449860 - DNA, 502 bp, Homo sapiens
  misc_feature: HEFZJCU01BUUX8.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccaggg

SEQ ID NO: 449861 - DNA, 529 bp, Homo sapiens
  misc_feature: HEFZJCU01C3IKJ.49.21.B10.1.454.heavy.3.raw
agtcgagagacacgaccggtgctcgatttagtgtcgtcgcaagagagggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctattactgtgcacgacgccgttataccagaggcgtggtaccttgactcctggggccagggcacccgtggtcaccgtctcctcag

SEQ ID NO: 449862 - DNA, 515 bp, Homo sapiens
  misc_feature: HEFZJCU01BCKKM.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaaccggacgtactactccacctcgcttggacatctggggccggac

SEQ ID NO: 449863 - DNA, 506 bp, Homo sapiens
  misc_feature: HEFZJCU01DUTN0.52.86.H09.1.454.heavy.3.raw
cgcagtacgacacgaccggtgctcgatttagtgctatagacttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctggctgcctggtcaaggactacttccta

SEQ ID NO: 449864 - DNA, 466 bp, Homo sapiens
  misc_feature: HEFZJCU01DL3LZ.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttcccctggcgccctgctccaggagcacctccgagagcacagcggcctgggctgcctggtcaaggactacttccctacagtgct

SEQ ID NO: 449865 - DNA, 528 bp, Homo sapiens
  misc_feature: HEFZJCU01BBDRU.48.67.G01.1.454.heavy.3.raw
agtatacatacacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaagggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtgtacttgcacccgggatactactccaacttcggcttggacatctggggccaagggacctcggtcgtccg

SEQ ID NO: 449866 - DNA, 390 bp, Homo sapiens; identical to SEQ ID NO: 445211
  misc_feature: HEFZJCU01CYT34.13.42.D09.1.454.heavy.3.raw

SEQ ID NO: 449867 - DNA, 400 bp, Homo sapiens; identical to SEQ ID NO: 444452
  misc_feature: HEFZJCU01EEC0D.47.24.C02.1.454.heavy.3.raw

SEQ ID NO: 449868 - DNA, 504 bp, Homo sapiens; identical to SEQ ID NO: 447120
  misc_feature: HEFZJCU01CQMQX.10.38.D05.1.454.heavy.3.raw

SEQ ID NO: 449869 - DNA, 479 bp, Homo sapiens; identical to SEQ ID NO: 447128
  misc_feature: HEFZJCU01DAM5D.4.37.D04.1.454.heavy.3.raw

SEQ ID NO: 449870 - DNA, 506 bp, Homo sapiens
  misc_feature: HEFZJCU01CJFZQ.48.57.F02.1.454.heavy.3.raw
agtatacatacacgaccggtgctcgatttagctcgatatagttgggtttgggggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacccccgagagcacagcggccctgggctgcctggtcaaggactacttcctatgtatact

SEQ ID NO: 449871 - DNA, 483 bp, Homo sapiens
  misc_feature: HEFZJCU01A7H7M.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcagcctccaccaagggcccatcggtcttcccctggcgccctgctccaggagcacctccgagacggccctgggctgcctggtcaaggactacttcccatactcgta

SEQ ID NO: 449872 - DNA, 379 bp, Homo sapiens
  misc_feature: HEFZJCU01A11Z4.2.86.H09.1.454.heavy.3.raw
acgctcgacacacgaccggtgctcgatttagtgctatagacttggggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 449873 - DNA, 480 bp, Homo sapiens; identical to SEQ ID NO: 446171
  misc_feature: HEFZJCU01DHC6G.22.36.D03.1.454.heavy.3.raw

SEQ ID NO: 449874 - DNA, 518 bp, Homo sapiens
  misc_feature: HEFZJCU01DQWC0.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggagttggggatatctcttatagtgggagtacgaactacaatccgtcctcaagagtcgagtcatcatatccgtagacaggtccaggaacgaattctccctgaaagtgagttctgtgaccgtcgcagacacggctgtctattattgtgcgagacggcaaatatggttcagggagttcgactacgtggggccagggaaccctggtcaccgtctcctcagccctccacc

SEQ ID NO: 449875 - DNA, 503 bp, Homo sapiens
  misc_feature: HEFZJCU01C2BD4.8.38.D05.1.454.heavy.3.raw
ctcgcgtgtccacgaccggtgctcgatttagtatctgatagttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccgacacgcgag

SEQ ID NO: 449876 - DNA, 395 bp, Homo sapiens; identical to SEQ ID NO: 444517
  misc_feature: HEFZJCU01B2HRJ.16.68.G02.1.454.heavy.3.raw

SEQ ID NO: 449877 - DNA, 451 bp, Homo sapiens; identical to SEQ ID NO: 449175
  misc_feature: HEFZJCU01CHQ1K.51.37.D04.1.454.heavy.3.raw

SEQ ID NO: 449878 - DNA, 517 bp, Homo sapiens; identical to SEQ ID NO: 444897
  misc_feature: HEFZJCU01BS282.9.34.D01.1.454.heavy.3.raw

SEQ ID NO: 449879 - DNA, 413 bp, Homo sapiens
  misc_feature: HEFZJCU01AHIYF.49.83.H06.1.454.heavy.3.raw
agtcgagagacacgaccggtgctcgatttagatcacgtgcgtcgcgggcacgaccggtgctcgatttagacacgcgagaaagggaaaggggctggagtgggtggccaacataaaccaagatggaactgtggaagactacatagactctgtgaagggccgattcaccatctccagagacaacgccaagaattcattgtttctgcacatgagcagtctgagagtcgaggacacggccttctattattgtgtgagtcagagtggcccaacccattggagccagggaaccctagtcagcgtctcctcagcctccaccaagggcccatcggtcttcccctggcgccctgctccaggagcacctccgagagcacagcggccctgggctgcctggtcaaggactacttcctctctcgact

SEQ ID NO: 449880 - DNA, 520 bp, Homo sapiens
  misc_feature: HEFZJCU01CKBJX.49.67.G01.1.454.heavy.3.raw
agtcgagagacacgaccggtgctcgatttagagtatacatattgggtttgggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaacccggtcaccgtctcctctgcctccaccaagggcccatcggtcttcccctggcaccctcctccaagagcacctctgggggcacagcggccctggg

SEQ ID NO: 449881 - DNA, 494 bp, Homo sapiens
  misc_feature: HEFZJCU01BYZ9Y.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaggactac

SEQ ID NO: 449882 - DNA, 532 bp, Homo sapiens
  misc_feature: HEFZJCU01CKHGU.7.78.H01.1.454.heavy.3.raw
cgtgtctctacacgaccggtgctcgatttagtgtgagtagtttgggtttgggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaggg

SEQ ID NO: 449883 - DNA, 481 bp, Homo sapiens; identical to SEQ ID NO: 446362
  misc_feature: HEFZJCU01CWGXG.19.67.G01.1.454.heavy.3.raw

SEQ ID NO: 449884 - DNA, 508 bp, Homo sapiens; identical to SEQ ID NO: 445288
  misc_feature: HEFZJCU01BEL8L.51.43.D10.1.454.heavy.3.raw

SEQ ID NO: 449885 - DNA, 493 bp, Homo sapiens
  misc_feature: HEFZJCU01E0DEJ.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggtattctcgtctgcttatgga

SEQ ID NO: 449886 - DNA, 498 bp, Homo sapiens
  misc_feature: HEFZJCU01DRCSH.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggacttacc

SEQ ID NO: 449887 - DNA, 530 bp, Homo sapiens
  misc_feature: HEFZJCU01BAKD3.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggcagggaaccctggtgaccgtctcctcagcctccaccaagggcccagtcggtcttcccctggccgccctgctccgaggagcacctccgagagcacagcggcccgtgggtccg

SEQ ID NO: 449888 - DNA, 507 bp, Homo sapiens
  misc_feature: HEFZJCU01CJUXJ.2.49.E05.1.454.heavy.3.raw
acgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccgggggaggcttagttcagcctggggggtccctgagactctcctgtgcagcctctggattcaccttcagtcgctactggatgcactggttccgccaagttccagggaaggggctggagtgggtctcacgcattgatccatctgggaataggattaactacgcggcctccgtgaggggccgattcaccatctccagagacaacgccaggaacactctgtatctggaaatgagcagtctcagaggcgaggacacggctgtttattactgcacaagtgacgcgttcggggagactgactacgtggggccaggg

SEQ ID NO: 449889 - DNA, 379 bp, Homo sapiens; identical to SEQ ID NO: 444450
  misc_feature: HEFZJCU01A0OCS.47.77.G11.1.454.heavy.3.raw

SEQ ID NO: 449890 - DNA, 495 bp, Homo sapiens
  misc_feature: HEFZJCU01CVTU9.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaat

SEQ ID NO: 449891 - DNA, 522 bp, Homo sapiens
  misc_feature: HEFZJCU01DS3L5.12.40.D07.1.454.heavy.3.raw
atacgacgtacacgaccggtgctcgatttagtgatagagcgtaacaacagagggctcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccagggggaccctggtcatcgtctccccagcctccaccaagggcccatcggtcttcccctggcg

SEQ ID NO: 449892 - DNA, 495 bp, Homo sapiens
  misc_feature: HEFZJCU01CCNJG.53.87.H10.1.454.heavy.3.raw
cgcgtatacacacgaccggtgctcgatttagcagtactgcgttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggccctgggctgcctggtcaaggactacttcctcgtactgcg

SEQ ID NO: 449893 - DNA, 486 bp, Homo sapiens
  misc_feature: HEFZJCU01BN0BG.51.14.B03.1.454.heavy.3.raw
cgatcgtatacacgaccggtgctcgatttagtgtgagtagtttgggcctgatacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 449894 - DNA, 492 bp, Homo sapiens; identical to SEQ ID NO: 445919
  misc_feature: HEFZJCU01B0NAB.14.25.C03.1.454.heavy.3.raw

SEQ ID NO: 449895 - DNA, 396 bp, Homo sapiens; identical to SEQ ID NO: 444469
  misc_feature: HEFZJCU01DSEU1.47.46.E02.1.454.heavy.3.raw

SEQ ID NO: 449896 - DNA, 538 bp, Homo sapiens
  misc_feature: HEFZJCU01EACYI.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccggatgggtcctgtcccaggtgcagctgcaggagtcgggcccaggactggtgaagccttcacagaccctgtccctcacctgcactgtctctggtgactccatcaccggtactaattactactggagttggatccgccagcccccgggaagggcctggagtggattggatacgccttttacagtggagtcacctactacaacccgtccctcaagagccgagttaccatactctgtcgacacgtcccagaatcagttctccctggaggtgacctctgtgactgccgcagactcggccgtgtatttctgtgccagaacgcaaagcagcgcctactatacctttaaactttgacttcgtggggtcccagggatccctgggtccaccgtctcctcacgcctccaaccg

SEQ ID NO: 449897 - DNA, 522 bp, Homo sapiens
  misc_feature: HEFZJCU01DVDSE.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttccccctggcaccctcctccaagagcacctctgggggcacagcggcctgggctgcctggtcaac

SEQ ID NO: 449898 - DNA, 532 bp, Homo sapiens
  misc_feature: HEFZJCU01DCDS3.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaaataacctgagagccgaggacacggccatgtattactgtgtggggcatttacttgaccccgtggggccggggaaccctgggtcaccgtctccccaccctccaccg

SEQ ID NO: 449899 - DNA, 496 bp, Homo sapiens
  misc_feature: HEFZJCU01DRPQT.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctaccagtgct

SEQ ID NO: 449900 - DNA, 532 bp, Homo sapiens
  misc_feature: HEFZJCU01C879C.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttccccctggcaccctcctccaagagcacctctgggggcacagcggccctgggctgcctc

SEQ ID NO: 449901 - DNA, 399 bp, Homo sapiens
  misc_feature: HEFZJCU01DMWYW.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcgccctgggctgcctggtcaaggactacttcctacgtgagct

SEQ ID NO: 449902 - DNA, 378 bp, Homo sapiens
  misc_feature: HEFZJCU01CZZ42.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctggggcacagcggccctgggctgcctggtcaaggactacttcctacgtgagct

SEQ ID NO: 449903 - DNA, 465 bp, Homo sapiens; identical to SEQ ID NO: 445132
  misc_feature: HEFZJCU01DHIL8.5.86.H09.1.454.heavy.3.raw

SEQ ID NO: 449904 - DNA, 534 bp, Homo sapiens
  misc_feature: HEFZJCU01CQG59.17.28.C06.1.454.heavy.3.raw
  modified_base (370)..(370): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggccagggagccctggtcaccg

SEQ ID NO: 449905 - DNA, 535 bp, Homo sapiens; identical to SEQ ID NO: 448705
  misc_feature: HEFZJCU01CT8YA.17.28.C06.1.454.heavy.3.raw

SEQ ID NO: 449906 - DNA, 493 bp, Homo sapiens
  misc_feature: HEFZJCU01BM6ZY.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcaggggtctccatgaccagggacagggccatcagaacagcctacatggagctgaacagactgacatctgacgacacggccgtttattattgtgtgagagaggacccgatgacctc

SEQ ID NO: 449907 - DNA, 491 bp, Homo sapiens; identical to SEQ ID NO: 446104
  misc_feature: HEFZJCU01CAWPD.3.34.D01.1.454.heavy.3.raw

SEQ ID NO: 449908 - DNA, 491 bp, Homo sapiens
  misc_feature: HEFZJCU01CJHUX.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccaggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 449909 - DNA, 383 bp, Homo sapiens; identical to SEQ ID NO: 444673
  misc_feature: HEFZJCU01EZ6K3.11.61.F06.1.454.heavy.3.raw

SEQ ID NO: 449910 - DNA, 480 bp, Homo sapiens; identical to SEQ ID NO: 444657
  misc_feature: HEFZJCU01CZXU1.19.67.G01.1.454.heavy.3.raw

SEQ ID NO: 449911 - DNA, 509 bp, Homo sapiens
  misc_feature: HEFZJCU01DP85R.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagcgtggttttccgttgttaggctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgtttcttcaaatgaacagcctgagagccgatgacacggccgtgtattactgtgcgagagagtggggcccacgaacgtttacacgctatggacgtcgt

SEQ ID NO: 449912 - DNA, 379 bp, Homo sapiens; identical to SEQ ID NO: 444450
  misc_feature: HEFZJCU01BT2YI.47.77.G11.1.454.heavy.3.raw

SEQ ID NO: 449913 - DNA, 356 bp, Homo sapiens; identical to SEQ ID NO: 444460
  misc_feature: HEFZJCU01BC4C1.47.38.D05.1.454.heavy.3.raw

SEQ ID NO: 449914 - DNA, 447 bp, Homo sapiens
  misc_feature: HEFZJCU01DC7VZ.51.38.D05.1.454.heavy.3.raw
cgatcgtatacacgaccggtgctcgatttagtatctgatagttgggtttgggtagttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttccccctggcaccctcctccaagagcacctctgggggcacagcggccctgggctgcctggtcaaggactacttcctcgtagcact

SEQ ID NO: 449915 - DNA, 495 bp, Homo sapiens
  misc_feature: HEFZJCU01DY8KJ.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggcctgggctgcctggtcaaggactactcctacgtcgtat

SEQ ID NO: 449916 - DNA, 518 bp, Homo sapiens
  misc_feature: HEFZJCU01EU6LA.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattcaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttatactgtgcgagagattcgagtggttcggggacctcaccctggtctacttcgatctctggggcct

SEQ ID NO: 449917 - DNA, 398 bp, Homo sapiens; identical to SEQ ID NO: 444798
  misc_feature: HEFZJCU01CBMKE.4.60.F05.1.454.heavy.3.raw

SEQ ID NO: 449918 - DNA, 380 bp, Homo sapiens; identical to SEQ ID NO: 445304
  misc_feature: HEFZJCU01BVI59.3.26.C04.1.454.heavy.3.raw

SEQ ID NO: 449919 - DNA, 492 bp, Homo sapiens
  misc_feature: HEFZJCU01EB1QN.52.28.C06.1.454.heavy.3.raw
cgcagtacgacacgaccggtgctcgatttagagctcacgtattgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 449920 - DNA, 427 bp, Homo sapiens; identical to SEQ ID NO: 444708
  misc_feature: HEFZJCU01BSBN4.9.34.D01.1.454.heavy.3.raw

SEQ ID NO: 449921 - DNA, 524 bp, Homo sapiens
  misc_feature: HEFZJCU01DMX11.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatgaacccggtc

SEQ ID NO: 449922 - DNA, 487 bp, Homo sapiens
  misc_feature: HEFZJCU01DIJ0E.51.38.D05.1.454.heavy.3.raw
cgatcgtatacacgaccggtgctcgatttagtatctgatagttgggtttgggcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggtctac

SEQ ID NO: 449923 - DNA, 515 bp, Homo sapiens
  misc_feature: HEFZJCU01AYO50.48.16.B05.1.454.heavy.3.raw
agtatacatacacgaccggtgctcgatttagagctcacgtaagggaaaggggacccaacaaccacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagacctctggatacaccttcacgaactgtgctattcattgggtgcgacaggcccctggacaagggcttgagtggatggggtggatcaacaccaacactgggaacccaacgtatgcccagggcttcacaggacgatttgtcttctccttggacacctctgtcaatacggcacatctgcagatcaccagcctgaagactgaggacactgccgtgtattcttgtgtgagacgaagtagtagctcgccctcctttgactactggggccagggaaccctggtcaccgcct

SEQ ID NO: 449924 - DNA, 522 bp, Homo sapiens
  misc_feature: HEFZJCU01EX5QE.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccaggggacaatggtcaccgtctcttcagt

SEQ ID NO: 449925 - DNA, 510 bp, Homo sapiens
  misc_feature: HEFZJCU01CHECE.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttctggggccaggggacg

SEQ ID NO: 449926 - DNA, 392 bp, Homo sapiens; identical to SEQ ID NO: 444682
  misc_feature: HEFZJCU01DYV6Q.16.70.G04.1.454.heavy.3.raw

SEQ ID NO: 449927 - DNA, 491 bp, Homo sapiens; identical to SEQ ID NO: 446104
  misc_feature: HEFZJCU01A76WC.3.34.D01.1.454.heavy.3.raw

SEQ ID NO: 449928 - DNA, 510 bp, Homo sapiens
  misc_feature: HEFZJCU01DUEB4.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctccaggagcacctccgagagcacagcggccctggg

SEQ ID NO: 449929 - DNA, 464 bp, Homo sapiens
  misc_feature: HEFZJCU01DTE21.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactactcccacgagagta

SEQ ID NO: 449930 - DNA, 491 bp, Homo sapiens; identical to SEQ ID NO: 444749
  misc_feature: HEFZJCU01BSG4S.11.13.B02.1.454.heavy.3.raw

SEQ ID NO: 449931 - DNA, 500 bp, Homo sapiens; identical to SEQ ID NO: 444529
  misc_feature: HEFZJCU01A82WI.12.38.D05.1.454.heavy.3.raw

SEQ ID NO: 449932 - DNA, 511 bp, Homo sapiens; identical to SEQ ID NO: 448280
  misc_feature: HEFZJCU01EV5S6.16.71.G05.1.454.heavy.3.raw

SEQ ID NO: 449933 - DNA, 511 bp, Homo sapiens
  misc_feature: HEFZJCU01BJF9E.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccagcaagggcccatcggtcttcccctggccaccctcctccaagagcacctctgggggcacagcggcctgggctgcctggtcaaggactactcct

SEQ ID NO: 449934 - DNA, 497 bp, Homo sapiens
  misc_feature: HEFZJCU01BRX72.52.57.F02.1.454.heavy.3.raw
cgcagtacgacacgaccggtgctcgatttagctcgatatagttgggtttgggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggcctggcaccctggtcactgtcttctcagcctccaccaagggcccatcggtcttccccctggcaccctcctccaagagcacctctgggggcacagcggccctgggctgcctggtcaaggactacttcctatacgatcg

SEQ ID NO: 449935 - DNA, 522 bp, Homo sapiens; identical to SEQ ID NO: 446788
  misc_feature: HEFZJCU01EHSGJ.12.40.D07.1.454.heavy.3.raw

SEQ ID NO: 449936 - DNA, 483 bp, Homo sapiens
  misc_feature: HEFZJCU01CPR2P.11.23.C01.1.454.heavy.3.raw
  modified_base (481)..(481): a, c, t, g, unknown or other
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctcncg

SEQ ID NO: 449937 - DNA, 403 bp, Homo sapiens; identical to SEQ ID NO: 444540
  misc_feature: HEFZJCU01ATF37.16.72.G06.1.454.heavy.3.raw

SEQ ID NO: 449938 - DNA, 492 bp, Homo sapiens
  misc_feature: HEFZJCU01D3Z47.4.7.A07.1.454.heavy.3.raw
  modified_base (475)..(475): a, c, t, g, unknown or other
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagntttggggaatgaccact

SEQ ID NO: 449939 - DNA, 501 bp, Homo sapiens
  misc_feature: HEFZJCU01D491K.18.39.D06.1.454.heavy.3.raw
  modified_base (442)..(442): a, c, t, g, unknown or other
  modified_base (447)..(447): a, c, t, g, unknown or other
  modified_base (456)..(456): a, c, t, g, unknown or other
  modified_base (467)..(467): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcctccaccaagggcccatcggtctcccctggcncctcncacagcacncctcgggcacnacgccgtcgggcctggcctggcaggcacgtccac

SEQ ID NO: 449940 - DNA, 483 bp, Homo sapiens
  misc_feature: HEFZJCU01AXKFV.19.36.D03.1.454.heavy.3.raw
tactctcgtgcacgaccggtgctcgatttagctgcgtcacgacccaaaaaccacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacaggcccctggacaagggcttgagtggatgggatggatcagcgcttacagtcataacacaaactatgcaccgaaactccagggcagagtcaccataaccacagacacatccacgagcacagcctacatggaactgaggagcctgagagctgacgacacggccgtgtattactgtgcgaaatggggagatattgtactgatgctacctgcttctctgg

SEQ ID NO: 449941 - DNA, 500 bp, Homo sapiens; identical to SEQ ID NO: 444529
  misc_feature: HEFZJCU01BYWC3.12.38.D05.1.454.heavy.3.raw

SEQ ID NO: 449942 - DNA, 500 bp, Homo sapiens
  misc_feature: HEFZJCU01CZEUS.13.33.C11.1.454.heavy.3.raw
  modified_base (69)..(69): a, c, t, g, unknown or other
tcacgtactacacgaccggtgctcgatttagagtgagctcgttgggtttggggacccagcacccacatntgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaattgcaacgatgctttgatatgtggggccaagggacacg

SEQ ID NO: 449943 - DNA, 492 bp, Homo sapiens
  misc_feature: HEFZJCU01EW6UL.4.21.B10.1.454.heavy.3.raw
agcactgtagcacgaccggtgctcgatttagtgtcgtcgcaagagaggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggcccatcgtcttcccctggcgccctgctccaggagcacctccgagagcacagcggccctgggctgcctggtcaaggactacttccctacagtgct

SEQ ID NO: 449944 - DNA, 483 bp, Homo sapiens; identical to SEQ ID NO: 446587
  misc_feature: HEFZJCU01DDYG4.40.57.F02.1.454.heavy.3.raw

SEQ ID NO: 449945 - DNA, 506 bp, Homo sapiens
  misc_feature: HEFZJCU01CDXOZ.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggttgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacgacatgacaccg

SEQ ID NO: 449946 - DNA, 517 bp, Homo sapiens
  misc_feature: HEFZJCU01EL7WH.49.57.F02.1.454.heavy.3.raw
agtcgagagacacgaccggtgctcgatttagctcgatatagttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaaacctccctgtatctgcaaatgaacagtctcagaggtgaggacaccgccttctactactgtgacaaaagattacggtgaccacacctattttcgacctacg

SEQ ID NO: 449947 - DNA, 513 bp, Homo sapiens
  misc_feature: HEFZJCU01B92ZA.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccgtctactactgtgcgaaagaaggggcgtgggagttcttatatggtgatatgtggggcaaggga

SEQ ID NO: 449948 - DNA, 502 bp, Homo sapiens
  misc_feature: HEFZJCU01BDM0P.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtgggccagggaaccctggtcaccgtctcctcagcttccaccaagggcccatcggtcttcccctggcgccctgctccaggagcacctctggggc

SEQ ID NO: 449949 - DNA, 506 bp, Homo sapiens
  misc_feature: HEFZJCU01EY1KE.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcgtcaccgtctcctcagcctccaccaagggcccatcggtcttcccctggccg

SEQ ID NO: 449950 - DNA, 519 bp, Homo sapiens; identical to SEQ ID NO: 444867
  misc_feature: HEFZJCU01EWYJO.9.34.D01.1.454.heavy.3.raw

SEQ ID NO: 449951 - DNA, 499 bp, Homo sapiens
  misc_feature: HEFZJCU01AHBC8.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatgcagactctgtgagggccgattcaccatctccagagacaatgccaggaattcactgtatgtggaaatgaacagtctgagagccgaggacacggctctctattactgtgcgagagcccgaaataggtctacg

SEQ ID NO: 449952 - DNA, 402 bp, Homo sapiens
  misc_feature: HEFZJCU01D9EHP.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttccagtagtaca

SEQ ID NO: 449953 - DNA, 466 bp, Homo sapiens; identical to SEQ ID NO: 445374
  misc_feature: HEFZJCU01EJQ8J.16.78.H01.1.454.heavy.3.raw

SEQ ID NO: 449954 - DNA, 512 bp, Homo sapiens; identical to SEQ ID NO: 445279
  misc_feature: HEFZJCU01ANZIO.17.33.C11.1.454.heavy.3.raw

SEQ ID NO: 449955 - DNA, 517 bp, Homo sapiens
  misc_feature: HEFZJCU01CAP77.40.31.C09.1.454.heavy.3.raw
tctagcgactcacgaccggtgctcgatttagacgtctcatcaaggaaggaaggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggccccgagcgcagtggtcttttgatcgtcctttgatatggtggggccgaagggacaagtggtcaccgtctcttcacgcctccaccgaac

SEQ ID NO: 449956 - DNA, 396 bp, Homo sapiens; identical to SEQ ID NO: 444469
  misc_feature: HEFZJCU01DNPQH.47.46.E02.1.454.heavy.3.raw

SEQ ID NO: 449957 - DNA, 524 bp, Homo sapiens
  misc_feature: HEFZJCU01C1LQE.49.38.D05.1.454.heavy.3.raw
agtcgagagacacgaccggtgctcgatttagtatctgatagttgggtttggggtctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctgggggtccctgagactctcctgtgtagcctctgagttcacctttagagtctatgccatgagttgggtccgccaggctccagggaaggggctgggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggagccctacggcgggtccttacg

SEQ ID NO: 449958 - DNA, 508 bp, Homo sapiens; identical to SEQ ID NO: 446002
  misc_feature: HEFZJCU01CSWR3.9.78.H01.1.454.heavy.3.raw

SEQ ID NO: 449959 - DNA, 400 bp, Homo sapiens; identical to SEQ ID NO: 444452
  misc_feature: HEFZJCU01EASXC.47.24.C02.1.454.heavy.3.raw

SEQ ID NO: 449960 - DNA, 523 bp, Homo sapiens; identical to SEQ ID NO: 446270
  misc_feature: HEFZJCU01AY5UZ.12.40.D07.1.454.heavy.3.raw

SEQ ID NO: 449961 - DNA, 387 bp, Homo sapiens
  misc_feature: HEFZJCU01ECKT3.9.63.F08.1.454.heavy.3.raw
tgatacgtctcacgaccggtgctcgatttagcgatcgtataagggctggatcaacccttacaccggtcgcccaaactatgcagcgtcttttcggaacagggtcaccctgacctgggacgcgtcccgcaatacagcctccatggaattgaccacactgaaatctgacgacacggtcgtctactattgtgcgagggtcaatagtcttaccataaacggtgcccggacagatgattttttggatgtctggggccaaggtacagcggtcaccgtcgcctcagcctccaccaagggcccatcggtcttccccctggcaccctcctccaagagcacctctgggggcacagcggccctgggctgcctggtcaaggactacttccagacgtatca

SEQ ID NO: 449962 - DNA, 395 bp, Homo sapiens; identical to SEQ ID NO: 444517
  misc_feature: HEFZJCU01CNMP8.16.68.G02.1.454.heavy.3.raw

SEQ ID NO: 449963 - DNA, 490 bp, Homo sapiens
  misc_feature: HEFZJCU01DW2TR.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctggcgccctgctccaggagcacctccgagagcacagcggccctgggctgcctggtcaaggactacttcctacgtgagct

SEQ ID NO: 449964 - DNA, 492 bp, Homo sapiens; identical to SEQ ID NO: 446706
  misc_feature: HEFZJCU01BHXV2.11.71.G05.1.454.heavy.3.raw

SEQ ID NO: 449965 - DNA, 493 bp, Homo sapiens
  misc_feature: HEFZJCU01EVIRF.11.81.H04.1.454.heavy.3.raw
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcctgtgcagcgtctggattcaccttcaggagctatgacatgcactgggtccgccaggctccaggcaaggggctggagtgggtggcagttatatggtatgatggaagttataaatactatggagactccgtgaagggccgattcaccatctccagagacacttccaagaacacggtgtatctgcaaatgaacagcctgagagccgaggacatgg

SEQ ID NO: 449966 - DNA, 511 bp, Homo sapiens
  misc_feature: HEFZJCU01EY1YP.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggtttttttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggacacatgacaccg

SEQ ID NO: 449967 - DNA, 491 bp, Homo sapiens; identical to SEQ ID NO: 444749
  misc_feature: HEFZJCU01BVWEE.11.13.B02.1.454.heavy.3.raw

SEQ ID NO: 449968 - DNA, 512 bp, Homo sapiens
  misc_feature: HEFZJCU01EY2VT.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttagtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctgggttccgcgggtccgggt

SEQ ID NO: 449969 - DNA, 393 bp, Homo sapiens
  misc_feature: HEFZJCU01AHDMJ.5.70.G04.1.454.heavy.3.raw
atcagacacgcacgaccggtgctcgatttagtgtagtgtgaagggaaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactggggcctgggaaccctggtcaccgtctcctcagcctccaccaagggcccatcggtcttccccctggcaccctcctccaagagcacctctgggggcacagcggccctgggctgcctggtcaaggactacttcccgtgtctgat

SEQ ID NO: 449970 - DNA, 498 bp, Homo sapiens
  misc_feature: HEFZJCU01AVM07.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcggacttctgggg

SEQ ID NO: 449971 - DNA, 520 bp, Homo sapiens
  misc_feature: HEFZJCU01B4UPM.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttattggggccaggga

SEQ ID NO: 449972 - DNA, 500 bp, Homo sapiens
  misc_feature: HEFZJCU01EREXW.17.10.A10.1.454.heavy.3.raw
  modified_base (460)..(460): a, c, t, g, unknown or other
cgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttct

SEQ ID NO: 449973 - DNA, 535 bp, Homo sapiens
  misc_feature: HEFZJCU01BX24B.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaacccgtggtcaccgtctcctcagcctccaccaagggcccatcggtcttccccctc

SEQ ID NO: 449974 - DNA, 513 bp, Homo sapiens
  misc_feature: HEFZJCU01D2AOS.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacagcggccg

SEQ ID NO: 449975 - DNA, 523 bp, Homo sapiens
  misc_feature: HEFZJCU01B791N.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctcgtcggggcc

SEQ ID NO: 449976 - DNA, 513 bp, Homo sapiens; identical to SEQ ID NO: 446452
  misc_feature: HEFZJCU01AJ2BB.17.33.C11.1.454.heavy.3.raw

SEQ ID NO: 449977 - DNA, 528 bp, Homo sapiens
  misc_feature: HEFZJCU01AJ4SG.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggtccatcggtcttcccctggcgccctgctccaggagcacctccgagacg

SEQ ID NO: 449978 - DNA, 500 bp, Homo sapiens
  misc_feature: HEFZJCU01AUR23.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagatccaaccccttacgt

SEQ ID NO: 449979 - DNA, 515 bp, Homo sapiens
  misc_feature: HEFZJCU01BT3AS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtggggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggggaactctggtcaccgtctccgcagcctccaccaagggccc

SEQ ID NO: 449980 - DNA, 476 bp, Homo sapiens
  misc_feature: HEFZJCU01CY4HB.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaaggcccatcggtcttccccctggcaccctcctccaagagcacctctgggggcacagcggccctgggctgcctggtcaaggactacttccgagtagtaca

SEQ ID NO: 449981 - DNA, 507 bp, Homo sapiens
  misc_feature: HEFZJCU01DPKR8.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaatagcctgagagccgacgacacggccatatattactgtgcgaaagcaccggcagttagtcacccatactactttgactactgggg

SEQ ID NO: 449982 - DNA, 517 bp, Homo sapiens; identical to SEQ ID NO: 446891
  misc_feature: HEFZJCU01ENQS3.17.33.C11.1.454.heavy.3.raw

SEQ ID NO: 449983 - DNA, 508 bp, Homo sapiens
  misc_feature: HEFZJCU01CK9GB.16.71.G05.1.454.heavy.3.raw
  modified_base (137)..(137): a, c, t, g, unknown or other
tgtactactccacgaccggtgctcgatttagtgtcgtcgcaagagagaggagcccagccctgggattttcaggtgttttcatttggtgatcaggactgaacagagagaactcaccatggagtctgggctgagcgtgngtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctgggaatgggtctcaggtattactggtggtggttataccacatactacgcagactccgtgaagggccggttcaccatctccagagacaattccaagaacacactgtatctgcaaatgaacagcctgagagccgacgacacggccatatatactgtgcgaaagcacggcagttatcacccataactactttgactactggggcc

SEQ ID NO: 449984 - DNA, 518 bp, Homo sapiens; identical to SEQ ID NO: 447436
  misc_feature: HEFZJCU01D27VN.13.76.G10.1.454.heavy.3.raw

SEQ ID NO: 449985 - DNA, 451 bp, Homo sapiens
  misc_feature: HEFZJCU01A2PH1.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcggtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 449986 - DNA, 521 bp, Homo sapiens
  misc_feature: HEFZJCU01DIVNC.12.71.G05.1.454.heavy.3.raw
  modified_base (464)..(464): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatattcgaccctggggccagggaacccaggtcaccgtctcctcagcctccaccaagggcccatccgtcttcccctggcgccctgctccaggngcacctccgagagcacagcggccctggggctggcctggtcaggactacttcctaccg

SEQ ID NO: 449987 - DNA, 534 bp, Homo sapiens
  misc_feature: HEFZJCU01BN88D.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggganccctggtcaccg

SEQ ID NO: 449988 - DNA, 379 bp, Homo sapiens; identical to SEQ ID NO: 444450
  misc_feature: HEFZJCU01EO2SV.47.77.G11.1.454.heavy.3.raw

SEQ ID NO: 449989 - DNA, 530 bp, Homo sapiens
  misc_feature: HEFZJCU01C588Z.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaacgggcccatcggtcttcccctggccgccctgctccaggagcacctccgagacg

SEQ ID NO: 449990 - DNA, 512 bp, Homo sapiens
  misc_feature: HEFZJCU01ESV2D.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatacgtggggccagggaaccctggtcgtccg

SEQ ID NO: 449991 - DNA, 501 bp, Homo sapiens
  misc_feature: HEFZJCU01D4T48.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtgatcca

SEQ ID NO: 449992 - DNA, 506 bp, Homo sapiens
  misc_feature: HEFZJCU01ENADJ.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgaccggggctcctcaatggctttcattacg

SEQ ID NO: 449993 - DNA, 510 bp, Homo sapiens
  misc_feature: HEFZJCU01D0CNW.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggaattaggggctgagtacggtatggacgtctggggccaagggaccacggtcaccgtctcctc

SEQ ID NO: 449994 - DNA, 401 bp, Homo sapiens
  misc_feature: HEFZJCU01CN27U.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtcgagct

SEQ ID NO: 449995 - DNA, 523 bp, Homo sapiens; identical to SEQ ID NO: 446270
  misc_feature: HEFZJCU01CI53Y.12.40.D07.1.454.heavy.3.raw

SEQ ID NO: 449996 - DNA, 379 bp, Homo sapiens
  misc_feature: HEFZJCU01DWNUS.47.77.G11.1.454.heavy.3.raw
agctcacgtacacgaccggtgctcgatttagctagtcactcaagggaaaggggctggagtgggtctcaggcattggtggtagtggtgctaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 449997 - DNA, 523 bp, Homo sapiens
  misc_feature: HEFZJCU01B47WO.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggccatcggtcttcccctgcgcctgctccaggagcacctccgagagcacagcggccctgggcg

SEQ ID NO: 449998 - DNA, 494 bp, Homo sapiens
  misc_feature: HEFZJCU01DIZOA.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaatgaccagcctgagagccgaggacacgggtgtttattactgtgggagaaatcctagtggc

SEQ ID NO: 449999 - DNA, 518 bp, Homo sapiens; identical to SEQ ID NO: 444718
  misc_feature: HEFZJCU01D64Q1.9.34.D01.1.454.heavy.3.raw

SEQ ID NO: 450000 - DNA, 516 bp, Homo sapiens
  misc_feature: HEFZJCU01AK6SI.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtcctcaagagtcgactcaccatatccgtagacacgtccaagaaccagttctccctgaagctgagctctgtgaccgccgcagacacggctgtgtattactgtgcggagggggccgggatattgttatagaaccacctgctatctgagctggttcgactgcgtgggggccaggggaacccctggtccaccg

SEQ ID NO: 450001 - DNA, 505 bp, Homo sapiens; identical to SEQ ID NO: 446616
  misc_feature: HEFZJCU01DA5JM.51.65.F10.1.454.heavy.3.raw

SEQ ID NO: 450002 - DNA, 411 bp, Homo sapiens; identical to SEQ ID NO: 445580
  misc_feature: HEFZJCU01AVZR8.51.31.C09.1.454.heavy.3.raw

SEQ ID NO: 450003 - DNA, 316 bp, Homo sapiens; identical to SEQ ID NO: 444479
  misc_feature: HEFZJCU01AUBI9.47.84.H07.1.454.heavy.3.raw

SEQ ID NO: 450004 - DNA, 491 bp, Homo sapiens; identical to SEQ ID NO: 446104
  misc_feature: HEFZJCU01DM3KW.3.34.D01.1.454.heavy.3.raw

SEQ ID NO: 450005 - DNA, 533 bp, Homo sapiens
  misc_feature: HEFZJCU01B6CN7.8.33.C11.1.454.heavy.3.raw
ctcgcgtgtccacgaccggtgctcgatttagagtgagctcgttggggtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggagggggaaccagcgggagttccaagtactcctttgacgtctggggccagggtaccctggtcaccgtctcctcagcctccaccaagggcccatcggtcttcccctggcgccctgctccaggagcacctccgagagcacacg

SEQ ID NO: 450006 - DNA, 396 bp, Homo sapiens; identical to SEQ ID NO: 444469
  misc_feature: HEFZJCU01EXDNP.47.46.E02.1.454.heavy.3.raw

SEQ ID NO: 450007 - DNA, 479 bp, Homo sapiens
  misc_feature: HEFZJCU01CFXBC.48.36.D03.1.454.heavy.3.raw
agtatacatacacgaccggtgctcgatttagctgcgtcacgatctctcttgggggcatcacataacaaccacatccctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcagtgaaggtctcctgccaggcttctggaggcaccttcagcagcaatgctatcaactgggtgcgacaggcccctggacaagggcttgagtggatgggagggatcatccctatgtttgctacaacaaactacgcacagaagtttcagggcagaatcacgattaccgcggacgaatccacgagcacagcctacatggagctgagcagcctgacatcagaggacacgggcctatttattactgtgcgagagtagttcgactt

SEQ ID NO: 450008 - DNA, 381 bp, Homo sapiens
  misc_feature: HEFZJCU01DLVSS.19.80.H03.1.454.heavy.3.raw
tactctcgtgcacgaccggtgctcgatttagctgtgcgtcgaagggaaaggggctggagtgggtggccaacataaagccagatggaagtgagagatcttatgtggactctgtgaagggccgattcagcatctccagagacaacgccaagaattcactgtttctgcaaataaacagcctgagagccgaggacacggctgtctactattgtgtgagagaggataagaatacttttgatttctggggccaggggacaacggtcaccgtctcttcagcctccaccaagggcccatcggtcttccccctggcgccctgctccaggagcacctccgagagcacagcggccctggctgcctggtcaaggactacttcccacgagagta

SEQ ID NO: 450009 - DNA, 524 bp, Homo sapiens
  misc_feature: HEFZJCU01ETGA6.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgacctagtggggccggggaaccctggtcaccgtctcttcagcctccaccaaggcccagtcggtcttccccgtggccacccgtccttccaagacgccacctctcggggggcac

SEQ ID NO: 450010 - DNA, 501 bp, Homo sapiens; identical to SEQ ID NO: 445341
  misc_feature: HEFZJCU01DCA5I.48.34.D01.1.454.heavy.3.raw

SEQ ID NO: 450011 - DNA, 514 bp, Homo sapiens
  misc_feature: HEFZJCU01BP07I.40.67.G01.1.454.heavy.3.raw
tctagcgactcacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcgcttggacatctggggccgac

SEQ ID NO: 450012 - DNA, 540 bp, Homo sapiens
  misc_feature: HEFZJCU01EUM3G.16.39.D06.1.454.heavy.3.raw
tgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccgtggggccagggaaccgtggtcaccgtctcctcagcctccaccaac

SEQ ID NO: 450013 - DNA, 464 bp, Homo sapiens; identical to SEQ ID NO: 445533
  misc_feature: HEFZJCU01CRRU2.19.10.A10.1.454.heavy.3.raw

SEQ ID NO: 450014 - DNA, 462 bp, Homo sapiens
  misc_feature: HEFZJCU01D9WYV.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattgggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 450015 - DNA, 513 bp, Homo sapiens
  misc_feature: HEFZJCU01BUO6P.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctggggccaagggaccgcggtcaccgtctcctcagcctccaccaagggcccatcggtcttcccctggcaccctcctccaagagcacctctgggggcacagcggcctgggctgcctggtcaaggactacttcctagtacgtga

SEQ ID NO: 450016 - DNA, 502 bp, Homo sapiens
  misc_feature: HEFZJCU01ES2D4.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgtc

SEQ ID NO: 450017 - DNA, 505 bp, Homo sapiens
  misc_feature: HEFZJCU01BXBH9.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggccatcggtcttcccctggcgccctgctccaggagcacctccgagagcacagcggccctgggctgcctggtcaaggactacttcctatgtatact

SEQ ID NO: 450018 - DNA, 526 bp, Homo sapiens
  misc_feature: HEFZJCU01AMH6E.49.35.D02.1.454.heavy.3.raw
agtcgagagacacgaccggtgctcgatttagcacacgatagttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggatctcagaggtgaggacaccgccttctactactgtgcaaaagattacggtgaccacaccttattttgaccactgcggccagggaaccctagtcaccgtctcctcagcctccaccaacgggcccatcggtcttccccctggcaccctcctccaagagcacctctgggggcacagcggcctgggctgcctggtcaaggactactt

SEQ ID NO: 450019 - DNA, 523 bp, Homo sapiens
  misc_feature: HEFZJCU01BX3KR.11.25.C03.1.454.heavy.3.raw
  modified_base (372)..(372): a, c, t, g, unknown or other
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggggtccgccaggctccagggaaggggctggagtgggtctcctttatttacagcagtggtagtacatattccgcagactccgtnaggggccgattcaccatctccagagacaactctaagaacacgctgttcttcaatgaacagcctgagagccgatgacacggccgtgtattactgtgcgagagatggggccacgaacgttactacgctatggacgtctgggccaagggaccac

SEQ ID NO: 450020 - DNA, 523 bp, Homo sapiens
  misc_feature: HEFZJCU01D4FLT.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatgggggccaggggacagcggtcaccgtctcttcag

SEQ ID NO: 450021 - DNA, 450 bp, Homo sapiens; identical to SEQ ID NO: 447544
  misc_feature: HEFZJCU01BM32L.10.38.D05.1.454.heavy.3.raw

SEQ ID NO: 450022 - DNA, 528 bp, Homo sapiens
  misc_feature: HEFZJCU01D1OKC.21.78.H01.1.454.heavy.3.raw
tcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaacccgtggtcaccgtctcccaccctccaccac

SEQ ID NO: 450023 - DNA, 489 bp, Homo sapiens; identical to SEQ ID NO: 444791
  misc_feature: HEFZJCU01AMN1H.47.85.H08.1.454.heavy.3.raw

SEQ ID NO: 450024 - DNA, 517 bp, Homo sapiens
  misc_feature: HEFZJCU01E104A.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccgagggaaccctggtcaccgtctcctcagcctccaccaagggcccatcggtcttcccctcggcgccctcgctccaggagcacctccgacgagcacagcggccctcgggcgtgcctggtcaaggactactt

SEQ ID NO: 450025 - DNA, 471 bp, Homo sapiens
  misc_feature: HEFZJCU01EW6H6.48.1.A01.1.454.heavy.3.raw
agtatacatacacgaccggtgctcgatttagacgtctcatcaagggaggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggactactggggccagggaaccctagtcaccgtctcctcagcctccaccaagggcccatcggtcttcccctggcgccctgctccaggagcacctccgagagcacagcggccctgggctgcctggtcaaggactacttcctatgtatact

SEQ ID NO: 450026 - DNA, 470 bp, Homo sapiens; identical to SEQ ID NO: 444866
  misc_feature: HEFZJCU01DTCA6.4.36.D03.1.454.heavy.3.raw

SEQ ID NO: 450027 - DNA, 525 bp, Homo sapiens
  misc_feature: HEFZJCU01ELJOK.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagccggccctgggctgcctggtcaaggactacttcccgtgtctgat

SEQ ID NO: 450028 - DNA, 437 bp, Homo sapiens; identical to SEQ ID NO: 447018
  misc_feature: HEFZJCU01ESFUC.40.27.C05.1.454.heavy.3.raw

SEQ ID NO: 450029 - DNA, 517 bp, Homo sapiens
  misc_feature: HEFZJCU01AQQ9W.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgttaggctatttaaaaggtagcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtatttactgtgcgagagatggggcccacgaacgttactacgctatggacgtcgtggggaccg

SEQ ID NO: 450030 - DNA, 513 bp, Homo sapiens
  misc_feature: HEFZJCU01BQGP2.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtgggccagggaaccctggtcaccgtctcctcagcttccaccaacgggcccagtccggtccttccccctcggccgccctgctccaggagcacctcgtgggggcac

SEQ ID NO: 450031 - DNA, 518 bp, Homo sapiens; identical to SEQ ID NO: 445810
  misc_feature: HEFZJCU01AVTP6.2.11.A11.1.454.heavy.3.raw

SEQ ID NO: 450032 - DNA, 488 bp, Homo sapiens
  misc_feature: HEFZJCU01CJ7US.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagacgcacagcggccctgggctgcctggtcaggactacttccatactcgta

SEQ ID NO: 450033 - DNA, 396 bp, Homo sapiens; identical to SEQ ID NO: 444469
  misc_feature: HEFZJCU01CUOWB.47.46.E02.1.454.heavy.3.raw

SEQ ID NO: 450034 - DNA, 501 bp, Homo sapiens
  misc_feature: HEFZJCU01AUQ09.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggccgccctgctccaggagcacctccgagagcacagcggccctgggctgcctggtcaaggactacttcctacgtcgtat

SEQ ID NO: 450035 - DNA, 401 bp, Homo sapiens
  misc_feature: HEFZJCU01BGIPA.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagagggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 450036 - DNA, 510 bp, Homo sapiens
  misc_feature: HEFZJCU01B8HEI.48.53.E09.1.454.heavy.3.raw
agtatacatacacgaccggtgctcgatttagagagagtgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaggactactt

SEQ ID NO: 450037 - DNA, 492 bp, Homo sapiens; identical to SEQ ID NO: 444695
  misc_feature: HEFZJCU01DMBWE.3.34.D01.1.454.heavy.3.raw

SEQ ID NO: 450038 - DNA, 495 bp, Homo sapiens
  misc_feature: HEFZJCU01CT1IO.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctgtcaaggactacttccgagtagtaca

SEQ ID NO: 450039 - DNA, 515 bp, Homo sapiens
  misc_feature: HEFZJCU01DLE6P.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggactccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctgggcccgggaaccctggtcaccgtctcctcagcctccaccaagggcccatcggtcttcccctggcaccctcctccaagagcacctctgggggcacagcggccctgggctgcctggtcaaggactacttcc

SEQ ID NO: 450040 - DNA, 494 bp, Homo sapiens
  misc_feature: HEFZJCU01EUDW6.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccaggagcacctctggggcacagcggccctgggctgcctggtcaggactacttcctacgtcgtat

SEQ ID NO: 450041 - DNA, 316 bp, Homo sapiens; identical to SEQ ID NO: 444444
  misc_feature: HEFZJCU01CLY6D.47.56.F01.1.454.heavy.3.raw

SEQ ID NO: 450042 - DNA, 514 bp, Homo sapiens
  misc_feature: HEFZJCU01D35C9.19.13.B02.1.454.heavy.3.raw
tactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctgggggacacggctgtgtattactgtgcgagagcggctggcaactacatccattacggtttggacgtctggggccaagggaccacggtcatcgtctccccagcctccaccaagggcccatcggtcttccccctggccgccctgctccaggagcacctcccgagagcacac

SEQ ID NO: 450043 - DNA, 506 bp, Homo sapiens
  misc_feature: HEFZJCU01A3QPU.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacggaaagcttttgatctctggggccaagggacactggtcaccgtctcttcagcctccaccaagggcccatcggtcttcccctggcgccctgctccaggacg

SEQ ID NO: 450044 - DNA, 517 bp, Homo sapiens
  misc_feature: HEFZJCU01DFNNY.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccagggaccg

SEQ ID NO: 450045 - DNA, 519 bp, Homo sapiens
  misc_feature: HEFZJCU01BZK5L.49.67.G01.1.454.heavy.3.raw
agtcgagagacacgaccggtgctcgatttagagtatacatattgggtttgggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaacccggtcaccgtctcctctgcctccaccaaggcccatcggtcttcccctggcaccctcctccaagagcacctctgggggcacagcggccctggg

SEQ ID NO: 450046 - DNA, 502 bp, Homo sapiens
  misc_feature: HEFZJCU01D31GV.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaagggctggagtgggttggccgtattaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactatatttcttt

SEQ ID NO: 450047 - DNA, 511 bp, Homo sapiens
  misc_feature: HEFZJCU01DDV55.19.13.B02.1.454.heavy.3.raw
tactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcacctttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctcccagcctccaccaagggcccatcggtcttcccctggcgccctgctccaggagcacctccgagagcacacg

SEQ ID NO: 450048 - DNA, 415 bp, Homo sapiens
  misc_feature: HEFZJCU01DLLXN.51.79.H02.1.454.heavy.3.raw
cgatcgtatacacgaccggtgctcgatttagtgtcacacgaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggcccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 450049 - DNA, 396 bp, Homo sapiens; identical to SEQ ID NO: 444469
  misc_feature: HEFZJCU01BHXL8.47.46.E02.1.454.heavy.3.raw

SEQ ID NO: 450050 - DNA, 495 bp, Homo sapiens
  misc_feature: HEFZJCU01DIM0R.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctctcggcttccaccaagggcccatcggtcttcccctggcgccctgctccaggagcacctctggggcacagcggccctgggctgcctggtcaaggactacttcctacgtcgtat

SEQ ID NO: 450051 - DNA, 506 bp, Homo sapiens
  misc_feature: HEFZJCU01C4KHZ.52.34.D01.1.454.heavy.3.raw
cgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacggcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 450052 - DNA, 383 bp, Homo sapiens; identical to SEQ ID NO: 444477
  misc_feature: HEFZJCU01BI7JA.47.60.F05.1.454.heavy.3.raw

SEQ ID NO: 450053 - DNA, 513 bp, Homo sapiens
  misc_feature: HEFZJCU01EG9VE.53.71.G05.1.454.heavy.3.raw
cgcgtatacacacgaccggtgctcgatttagtgtcgtcgcaagagagagggggatactttctgagactcatggacctcctgcacaagaacatgaaacacctgtggttcttcctcctgctggtggcagctcccagatgggtcctgtcccaagtgcggctgcaggagtcgggcccaggactggtgaagccttcggagaccctgtccctcacctgcgctgtctctggtgactccatcagtgatttctactggaactggatccgccagcccgccgggaagggactggagtggatcggccgtatccatcatagcgggagcaccaactacaacgcctccctcaagggtcgagtcgccatgtcactcgacacgtccaagaacctgttctccctgaggctgacctctgtgaccgcctcggacacggccgtatattactgtgcgagagagtcttattgtgctggtaataactgctacatcctctttgactttctggggcccgggaaccctgggtcaccgtct

SEQ ID NO: 450054 - DNA, 454 bp, Homo sapiens; identical to SEQ ID NO: 447777
  misc_feature: HEFZJCU01B0RH7.40.35.D02.1.454.heavy.3.raw

SEQ ID NO: 450055 - DNA, 498 bp, Homo sapiens
  misc_feature: HEFZJCU01D5JL1.53.1.A01.1.454.heavy.3.raw
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccccggacaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgcttttgat

SEQ ID NO: 450056 - DNA, 506 bp, Homo sapiens; identical to SEQ ID NO: 444696
  misc_feature: HEFZJCU01CBKYY.16.34.D01.1.454.heavy.3.raw

SEQ ID NO: 450057 - DNA, 498 bp, Homo sapiens
  misc_feature: HEFZJCU01CM6Q2.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaatgaacagcctgagagacgaggatacggctatttactattgtgcgcgatcgacagaaaagcggtggcctagtc

SEQ ID NO: 450058 - DNA, 488 bp, Homo sapiens; identical to SEQ ID NO: 449258
  misc_feature: HEFZJCU01BV0A5.12.53.E09.1.454.heavy.3.raw

SEQ ID NO: 450059 - DNA, 496 bp, Homo sapiens
  misc_feature: HEFZJCU01AU4IA.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggcctggcaccctggtcactgtctcctcggcttccaccaagggcccatcggtcttcccctggcgccctgctccaggagcacctctgggggcacagcggccctgggctgcctggtcaaggactacttcctacgtcgtat

SEQ ID NO: 450060 - DNA, 501 bp, Homo sapiens
  misc_feature: HEFZJCU01D14B2.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccagagcacctccgagagcacagcggcccgtgggctgcctggtcaaggactacttcctatgtatact

SEQ ID NO: 450061 - DNA, 499 bp, Homo sapiens
  misc_feature: HEFZJCU01B4JFC.9.76.G10.1.454.heavy.3.raw
tgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgatggaattaaaaatactatgcagactccgtgaagggccgattcaccatctccagagacaactccaagaacacgctgtttctgcaaatgaacagcctgagagctgaggacacggctgtgtatttctgtgctcaagataggtgggacttcgattctttggagtggt

SEQ ID NO: 450062 - DNA, 523 bp, Homo sapiens; identical to SEQ ID NO: 445239
  misc_feature: HEFZJCU01DTICV.9.78.H01.1.454.heavy.3.raw

SEQ ID NO: 450063 - DNA, 522 bp, Homo sapiens; identical to SEQ ID NO: 446788
  misc_feature: HEFZJCU01DA802.12.40.D07.1.454.heavy.3.raw

SEQ ID NO: 450064 - DNA, 463 bp, Homo sapiens; identical to SEQ ID NO: 446208
  misc_feature: HEFZJCU01EAMXT.19.10.A10.1.454.heavy.3.raw

SEQ ID NO: 450065 - DNA, 512 bp, Homo sapiens
  misc_feature: HEFZJCU01CMK1E.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggtttgactactggggccagggaagcttggtcaccgtctcc

SEQ ID NO: 450066 - DNA, 512 bp, Homo sapiens
  misc_feature: HEFZJCU01EIB99.10.38.D05.1.454.heavy.3.raw
  modified_base (480)..(480): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgggttcaccctctccagagacacttccaacaacatcttgtatcttcacatgcacaatctgagagtcggacgacacggccacctattattgttgcgtcggcanagtactacgctctaatctggggtccgagggac

SEQ ID NO: 450067 - DNA, 518 bp, Homo sapiens
  misc_feature: HEFZJCU01DJXZ2.9.70.G04.1.454.heavy.3.raw
  modified_base (271)..(271): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggnagtccgccggcaagggactggagtatattggacgaatctatgccagtggaccgccatctacaacccgtcctcaagagtcgagtcagcatgtcagtcgacacgtccagaaccagttctccctgacagtgagttatatgaccgccgcagacacggccgtgtattactgtgcgagagaggccgttattttaggaccagctagttaaaactcctaactacggtctggacgtcgtggggccagggaccgaac

SEQ ID NO: 450068 - DNA, 519 bp, Homo sapiens
  misc_feature: HEFZJCU01CYGSQ.48.70.G04.1.454.heavy.3.raw
agtatacatacacgaccggtgctcgatttagtgtagtgtgaagggaaaggggctgggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccgggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccg

SEQ ID NO: 450069 - DNA, 519 bp, Homo sapiens; identical to SEQ ID NO: 445330
  misc_feature: HEFZJCU01AV7DK.7.78.H01.1.454.heavy.3.raw

SEQ ID NO: 450070 - DNA, 487 bp, Homo sapiens
  misc_feature: HEFZJCU01C08D2.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttccccctggcgccctgctccaggagcacctccgagagcacagcggccctgggctgcctggtcaaggactacttcctacgtgagct

SEQ ID NO: 450071 - DNA, 508 bp, Homo sapiens
  misc_feature: HEFZJCU01CO45O.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaagggcccatccggtcttcccctggcgccctgctccaggacg

SEQ ID NO: 450072 - DNA, 378 bp, Homo sapiens
  misc_feature: HEFZJCU01D1YPO.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 450073 - DNA, 509 bp, Homo sapiens
  misc_feature: HEFZJCU01D9T2W.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 450074 - DNA, 406 bp, Homo sapiens
  misc_feature: HEFZJCU01DYJYP.51.41.D08.1.454.heavy.3.raw
cgatcgtatacacgaccggtgctcgatttagtcacgcgagaaagggaaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgttcgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctcgtagcact

SEQ ID NO: 450075 - DNA, 508 bp, Homo sapiens; identical to SEQ ID NO: 445594
  misc_feature: HEFZJCU01BUUAS.17.25.C03.1.454.heavy.3.raw

SEQ ID NO: 450076 - DNA, 518 bp, Homo sapiens; identical to SEQ ID NO: 444718
  misc_feature: HEFZJCU01C77I7.9.34.D01.1.454.heavy.3.raw

SEQ ID NO: 450077 - DNA, 511 bp, Homo sapiens
  misc_feature: HEFZJCU01BH4U5.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctcccagcctccaccaagggcccatcggtcttcccctgcgccctgctccaggagcacc

SEQ ID NO: 450078 - DNA, 493 bp, Homo sapiens
  misc_feature: HEFZJCU01DYL4L.4.7.A07.1.454.heavy.3.raw
  modified_base (475)..(475): a, c, t, g, unknown or other
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttcttggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtataattctgtgcgaaagntttggggaatgaccactc

SEQ ID NO: 450079 - DNA, 528 bp, Homo sapiens
  misc_feature: HEFZJCU01DG4FG.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggccgcctgctccaggagcacctccgagacg

SEQ ID NO: 450080 - DNA, 515 bp, Homo sapiens
  misc_feature: HEFZJCU01ERL6L.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtctggtacgg

SEQ ID NO: 450081 - DNA, 385 bp, Homo sapiens; identical to SEQ ID NO: 444438
  misc_feature: HEFZJCU01DWXSO.18.60.F05.1.454.heavy.3.raw

SEQ ID NO: 450082 - DNA, 500 bp, Homo sapiens
  misc_feature: HEFZJCU01CXZPN.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcactgtctcctcagcctccaccaaggcccatcggtcttcccctggcgccctgctccaggagcacctccgagagcacagcggccctgggctgcctggtcaaggactacttccagtatagtct

SEQ ID NO: 450083 - DNA, 500 bp, Homo sapiens; identical to SEQ ID NO: 444529
  misc_feature: HEFZJCU01EKZUP.12.38.D05.1.454.heavy.3.raw

SEQ ID NO: 450084 - DNA, 531 bp, Homo sapiens
  misc_feature: HEFZJCU01AXNEG.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaacgg

SEQ ID NO: 450085 - DNA, 492 bp, Homo sapiens
  misc_feature: HEFZJCU01B0RBZ.4.21.B10.1.454.heavy.3.raw
agcactgtagcacgaccggtgctcgatttagtgtcgtcgcaagagagggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggcctgggctgcctggtcaaggactatttcctacagtgct

SEQ ID NO: 450086 - DNA, 400 bp, Homo sapiens; identical to SEQ ID NO: 444452
  misc_feature: HEFZJCU01EJW96.47.24.C02.1.454.heavy.3.raw

SEQ ID NO: 450087 - DNA, 480 bp, Homo sapiens; identical to SEQ ID NO: 446171
  misc_feature: HEFZJCU01BR66K.22.36.D03.1.454.heavy.3.raw

SEQ ID NO: 450088 - DNA, 505 bp, Homo sapiens; identical to SEQ ID NO: 445664
  misc_feature: HEFZJCU01EUDGG.12.33.C11.1.454.heavy.3.raw

SEQ ID NO: 450089 - DNA, 521 bp, Homo sapiens
  misc_feature: HEFZJCU01A8295.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggccaccctcctccaagagcacctctgggggcacagcggccctgggctgcctggtcaaggactacttccgagtagtactac

SEQ ID NO: 450090 - DNA, 505 bp, Homo sapiens
  misc_feature: HEFZJCU01EZ3GZ.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttattactgtgcgaaaccatcacgtataactggaactacgta

SEQ ID NO: 450091 - DNA, 445 bp, Homo sapiens
  misc_feature: HEFZJCU01EZI2D.48.41.D08.1.454.heavy.3.raw
agtatacatacacgaccggtgctcgatttagtcacgcgagaaagggaaaggggactagaaggggaactggtcttaattgcttgatgaagagcaggagactcatttatgtgagtcttttgagtgaccattgtctgggtcactcccatttaactttccctaaagcccatttgaaggagaggtcgcacgagctgctccacaacctctgaatggggatggcatgggtaatgatgcttgagaacataccaagccccactggcatcgcccttgtctaagtcattgactgtaggtcatcatcgcacccttgaaagtagcccatgccttccaaagcgatttatgcctccaccaagggcccatcggtcttccccctggcaccctcctccaagagcacctctgggggcacagcggccctgggctgcctggtcaaggactacttcctatgtatact

SEQ ID NO: 450092 - DNA, 527 bp, Homo sapiens
  misc_feature: HEFZJCU01D5TP9.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacctggtcaccgtctccccaccctccaccg

SEQ ID NO: 450093 - DNA, 380 bp, Homo sapiens
  misc_feature: HEFZJCU01DUNFF.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggtccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 450094 - DNA, 490 bp, Homo sapiens; identical to SEQ ID NO: 449963
  misc_feature: HEFZJCU01CDNZR.47.85.H08.1.454.heavy.3.raw

SEQ ID NO: 450095 - DNA, 519 bp, Homo sapiens
  misc_feature: HEFZJCU01ELGAW.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctggggccagggaacccttgtcaccgtctcctcagcctccaccaagggcccacg

SEQ ID NO: 450096 - DNA, 384 bp, Homo sapiens; identical to SEQ ID NO: 444454
  misc_feature: HEFZJCU01D85A5.11.61.F06.1.454.heavy.3.raw

SEQ ID NO: 450097 - DNA, 384 bp, Homo sapiens; identical to SEQ ID NO: 444454
  misc_feature: HEFZJCU01D4WL8.11.61.F06.1.454.heavy.3.raw

SEQ ID NO: 450098 - DNA, 537 bp, Homo sapiens; identical to SEQ ID NO: 445697
  misc_feature: HEFZJCU01BPBHB.14.57.F02.1.454.heavy.3.raw

SEQ ID NO: 450099 - DNA, 505 bp, Homo sapiens
  misc_feature: HEFZJCU01EU9PI.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgcgggacttcgtgggccaac

SEQ ID NO: 450100 - DNA, 518 bp, Homo sapiens; identical to SEQ ID NO: 445810
  misc_feature: HEFZJCU01D9611.2.11.A11.1.454.heavy.3.raw

SEQ ID NO: 450101 - DNA, 370 bp, Homo sapiens
  misc_feature: HEFZJCU01CZN57.3.42.D09.1.454.heavy.3.raw
agacgcactccacgaccggtgctcgatttagacacatacgcagggaaaggggctggagtggattgggagtttctattatggtgggggaacctactacaacccgtccctcaagagtcgagtcaccatatccttagacacgtccaagaaccaattctccctgaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctggggcacagcggccctgggctgcctggtcaaggactacttccgagtgcgtct

SEQ ID NO: 450102 - DNA, 537 bp, Homo sapiens
  misc_feature: HEFZJCU01C2DH8.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaataacgaacacagttaatctgagctgaacagcctgtcatctgaggacacgggcttctacttctgtgcgaggagtaattactataacactgcttcctttttacaccttcccttgtacttcgtcggggccagtcggaaccccggtcaccggtt

SEQ ID NO: 450103 - DNA, 396 bp, Homo sapiens; identical to SEQ ID NO: 444469
  misc_feature: HEFZJCU01EHTG5.47.46.E02.1.454.heavy.3.raw

SEQ ID NO: 450104 - DNA, 534 bp, Homo sapiens
  misc_feature: HEFZJCU01CC1FW.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggccgccctgctccaggagcacctccgagacgcacacgccggccccgtggggccg

SEQ ID NO: 450105 - DNA, 520 bp, Homo sapiens
  misc_feature: HEFZJCU01BVN18.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgatttttctagttggtccc

SEQ ID NO: 450106 - DNA, 515 bp, Homo sapiens
  misc_feature: HEFZJCU01EXAON.49.38.D05.1.454.heavy.3.raw
agtcgagagacacgaccggtgctcgatttagtatctgatagttgggtttgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggagccctacggcgggtcctactttgactactggggccgggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 450107 - DNA, 526 bp, Homo sapiens
  misc_feature: HEFZJCU01CPEGL.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccaggggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccacttaggtttgactactggggccaggggaagcgtttggtcaccgtctcctcagcct

SEQ ID NO: 450108 - DNA, 396 bp, Homo sapiens; identical to SEQ ID NO: 444469
  misc_feature: HEFZJCU01ARLP1.47.46.E02.1.454.heavy.3.raw

SEQ ID NO: 450109 - DNA, 316 bp, Homo sapiens; identical to SEQ ID NO: 444479
  misc_feature: HEFZJCU01A9Z9J.47.84.H07.1.454.heavy.3.raw

SEQ ID NO: 450110 - DNA, 534 bp, Homo sapiens
  misc_feature: HEFZJCU01E1LFZ.48.30.C08.1.454.heavy.3.raw
agtatacatacacgaccggtgctcgatttagtctgacgtcaaagggaaagggggaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccgagggaaccctggtcaccgtctcctcagcctccaccaacgggcccatcggtcttccccctcggccgccctcg

SEQ ID NO: 450111 - DNA, 539 bp, Homo sapiens
  misc_feature: HEFZJCU01CP1BW.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagcgtggagttttccttggctgctattttaaaaggtgtccagtgtgaggtgcagctggtggagtctgggggaggcttggtaaagccgggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctcccaccaacc

SEQ ID NO: 450112 - DNA, 492 bp, Homo sapiens; identical to SEQ ID NO: 444695
  misc_feature: HEFZJCU01BDV07.3.34.D01.1.454.heavy.3.raw

SEQ ID NO: 450113 - DNA, 517 bp, Homo sapiens
  misc_feature: HEFZJCU01CH0NP.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctcggcgccctgctccaggagccacctc

SEQ ID NO: 450114 - DNA, 482 bp, Homo sapiens; identical to SEQ ID NO: 444503
  misc_feature: HEFZJCU01DF0DQ.7.10.A10.1.454.heavy.3.raw

SEQ ID NO: 450115 - DNA, 315 bp, Homo sapiens; identical to SEQ ID NO: 444763
  misc_feature: HEFZJCU01A6WB5.47.56.F01.1.454.heavy.3.raw

SEQ ID NO: 450116 - DNA, 396 bp, Homo sapiens; identical to SEQ ID NO: 445818
  misc_feature: HEFZJCU01DA3TG.16.68.G02.1.454.heavy.3.raw

SEQ ID NO: 450117 - DNA, 512 bp, Homo sapiens
  misc_feature: HEFZJCU01EU0H5.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgaaacgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccagagcacctctggggcacagcggccctgggctgcctggtcaaggactacttcccata

SEQ ID NO: 450118 - DNA, 372 bp, Homo sapiens
  misc_feature: HEFZJCU01DPDW9.12.86.H09.1.454.heavy.3.raw
atacgacgtacacgaccggtgctcgatttagtgctatagacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccctggcgccctgctccaggagcacctccgagagcacagcggccctgggctgcctggtcaaggactacttcctacgtcgtat

SEQ ID NO: 450119 - DNA, 502 bp, Homo sapiens
  misc_feature: HEFZJCU01DHG6N.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgcaagaactccctgtatctgcaaatgaacagcctgagagctgaggacacggccttgtattattgtgcaaaagataccaaccccttacgtt

SEQ ID NO: 450120 - DNA, 505 bp, Homo sapiens
  misc_feature: HEFZJCU01DPXAG.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattgggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaatggacagcctgagagtcgaagacacggctgtgtattactgtgtgtctctgacgcctcggccggaccttggcttcg

SEQ ID NO: 450121 - DNA, 379 bp, Homo sapiens; identical to SEQ ID NO: 444676
  misc_feature: HEFZJCU01DIU56.47.77.G11.1.454.heavy.3.raw

SEQ ID NO: 450122 - DNA, 512 bp, Homo sapiens; identical to SEQ ID NO: 445688
  misc_feature: HEFZJCU01BAWWF.3.34.D01.1.454.heavy.3.raw

SEQ ID NO: 450123 - DNA, 506 bp, Homo sapiens
  misc_feature: HEFZJCU01EIZ50.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagagacaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 450124 - DNA, 492 bp, Homo sapiens
  misc_feature: HEFZJCU01BD97O.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggcgccctgctccaggagcacctctgggggcacagcggccctgggctgcctggtcaaggactacttccctacagtgct

SEQ ID NO: 450125 - DNA, 500 bp, Homo sapiens; identical to SEQ ID NO: 445720
  misc_feature: HEFZJCU01DEEPT.3.20.B09.1.454.heavy.3.raw

SEQ ID NO: 450126 - DNA, 496 bp, Homo sapiens
  misc_feature: HEFZJCU01DZDPM.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggg

SEQ ID NO: 450127 - DNA, 519 bp, Homo sapiens; identical to SEQ ID NO: 444867
  misc_feature: HEFZJCU01CZFOF.9.34.D01.1.454.heavy.3.raw

SEQ ID NO: 450128 - DNA, 434 bp, Homo sapiens
  misc_feature: HEFZJCU01CV6AR.11.25.C03.1.454.heavy.3.raw
cgagagataccacgaccggtgctcgatttagtagtgtagatttgggtttgggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 450129 - DNA, 499 bp, Homo sapiens
  misc_feature: HEFZJCU01CJGF5.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctactttgactactggggccggggaaccctggtcaccgt

SEQ ID NO: 450130 - DNA, 532 bp, Homo sapiens
  misc_feature: HEFZJCU01DIGCI.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacgcggagatatcgccatactacttcgactactggggccagggaaccctgatcaccgtctcctcagcctccaccaagggcccatcggtcttcccctggcaccctcctccaagagcacctctgggggcacagcggccctgggctgcctggtcaaggactactt

SEQ ID NO: 450131 - DNA, 508 bp, Homo sapiens; identical to SEQ ID NO: 445594
  misc_feature: HEFZJCU01EI55L.17.25.C03.1.454.heavy.3.raw

SEQ ID NO: 450132 - DNA, 310 bp, Homo sapiens; identical to SEQ ID NO: 444473
  misc_feature: HEFZJCU01CZ1OP.18.53.E09.1.454.heavy.3.raw

SEQ ID NO: 450133 - DNA, 500 bp, Homo sapiens
  misc_feature: HEFZJCU01CJL1F.52.19.B08.1.454.heavy.3.raw
cgcagtacgacacgaccggtgctcgatttagtgagtcagtaagggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatagtcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggccaccctcctccaagagcacctctgggggcacagcggcctgggctgcct

SEQ ID NO: 450134 - DNA, 501 bp, Homo sapiens
  misc_feature: HEFZJCU01BVEJF.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgctcc

SEQ ID NO: 450135 - DNA, 400 bp, Homo sapiens; identical to SEQ ID NO: 444452
  misc_feature: HEFZJCU01BO8O7.47.24.C02.1.454.heavy.3.raw

SEQ ID NO: 450136 - DNA, 509 bp, Homo sapiens
  misc_feature: HEFZJCU01CRRD5.48.81.H04.1.454.heavy.3.raw
  modified_base (472)..(472): a, c, t, g, unknown or other
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggaacggngctcggtttcggagttatcatctactactttgaattc

SEQ ID NO: 450137 - DNA, 492 bp, Homo sapiens; identical to SEQ ID NO: 445919
  misc_feature: HEFZJCU01ENQGH.14.25.C03.1.454.heavy.3.raw

SEQ ID NO: 450138 - DNA, 514 bp, Homo sapiens
  misc_feature: HEFZJCU01C4ABV.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcaccg

SEQ ID NO: 450139 - DNA, 518 bp, Homo sapiens
  misc_feature: HEFZJCU01BUD9W.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccataggtcttcccctggcaccctcctccaagagcacctctgggggcacagcggccctgggctgcctggtcaaggactacttccagacgtatca

SEQ ID NO: 450140 - DNA, 506 bp, Homo sapiens; identical to SEQ ID NO: 444696
  misc_feature: HEFZJCU01EHX58.16.34.D01.1.454.heavy.3.raw

SEQ ID NO: 450141 - DNA, 396 bp, Homo sapiens; identical to SEQ ID NO: 446990
  misc_feature: HEFZJCU01BYX8G.51.70.G04.1.454.heavy.3.raw

SEQ ID NO: 450142 - DNA, 498 bp, Homo sapiens; identical to SEQ ID NO: 445952
  misc_feature: HEFZJCU01BRRXT.11.71.G05.1.454.heavy.3.raw

SEQ ID NO: 450143 - DNA, 519 bp, Homo sapiens
  misc_feature: HEFZJCU01A2DP5.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagaatcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggcctgggctgcctggtcaaggactacttccgagtagtactac

SEQ ID NO: 450144 - DNA, 527 bp, Homo sapiens; identical to SEQ ID NO: 446218
  misc_feature: HEFZJCU01BP9QV.9.33.C11.1.454.heavy.3.raw

SEQ ID NO: 450145 - DNA, 499 bp, Homo sapiens
  misc_feature: HEFZJCU01BJUOD.48.71.G05.1.454.heavy.3.raw
agtatacatacacgaccggtgctcgatttagtgtcgtcgcaagagagaggggacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggaggggaagactggttcg

SEQ ID NO: 450146 - DNA, 535 bp, Homo sapiens
  misc_feature: HEFZJCU01AUNUW.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgacttttggaatggctatgactcgatcgactactggggccctggaatcctggtcaccgtctcctcagcctccaccaagggcccatcggtcttcccctggccaccct

SEQ ID NO: 450147 - DNA, 506 bp, Homo sapiens
  misc_feature: HEFZJCU01DM3TD.48.44.D11.1.454.heavy.3.raw
agtatacatacacgaccggtgctcgatttagcgcagtacgaggggaggcttggtccagcctggggggttcctgaaactctcctgtacagcccctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 450148 - DNA, 500 bp, Homo sapiens
  misc_feature: HEFZJCU01B17PY.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtctcaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 450149 - DNA, 481 bp, Homo sapiens; identical to SEQ ID NO: 445006
  misc_feature: HEFZJCU01D7S02.7.10.A10.1.454.heavy.3.raw

SEQ ID NO: 450150 - DNA, 386 bp, Homo sapiens
  misc_feature: HEFZJCU01APOWC.22.46.E02.1.454.heavy.3.raw
acatacgcgtcacgaccggtgctcgatttagactcatctacagggaaaggggctggtagtggatttcgatatattaacgatggagggaggacgaaaaggtacgcaaattctgtgaagggccgagtcaccatttccagagacaacgccaggaactcagtgtatctgcaatgaacagcctgacagccgaggacacggctgtctattactgtacgagagattggcaagcctgggcctttgatgtctggggccctgggacaatggtcaccgtctctttagcctccaccaagggcccatccggtcttccccctggcgccctgctccaggagcacctccgagagcacagcggccctgggctgcctggtcaaggactacttccagacgtatca

SEQ ID NO: 450151 - DNA, 495 bp, Homo sapiens
  misc_feature: HEFZJCU01AT4WP.51.30.C08.1.454.heavy.3.raw
cgatcgtatacacgaccggtgctcgatttagtctgacgtcaaagggaaaggggctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggagtgggtggcacttatctcatctgatggaaggtctgaatcttatgccgactccgtgaagggccgattcaccatctccagagacaattccaagaatacactatatcttcaaatgaacagtctgagacgtgaagacacggctgtctattactgtgcgactgagatgtcttattacg

SEQ ID NO: 450152 - DNA, 505 bp, Homo sapiens
  misc_feature: HEFZJCU01DK95L.51.71.G05.1.454.heavy.3.raw
cgatcgtatacacgaccggtgctcgatttagtgtcgtcgcaagagagagggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcc

SEQ ID NO: 450153 - DNA, 373 bp, Homo sapiens
  misc_feature: HEFZJCU01AL9NK.3.1.A01.1.454.heavy.3.raw
agacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgaggagggcggctttggggttcaggaccgtcctacgctatggacgtctggggccaagggaccacggtcaccgttctcctcagcctccaccaagggcccatcggtcttccccctggcgccctgctccaggagcacctccgagagcacagcggccctgggctgcctggtcaaggactacttccgagtgcgtct

SEQ ID NO: 450154 - DNA, 399 bp, Homo sapiens; identical to SEQ ID NO: 444863
  misc_feature: HEFZJCU01EKW3U.4.77.G11.1.454.heavy.3.raw

SEQ ID NO: 450155 - DNA, 374 bp, Homo sapiens; identical to SEQ ID NO: 444640
  misc_feature: HEFZJCU01D2OD1.7.37.D04.1.454.heavy.3.raw

SEQ ID NO: 450156 - DNA, 543 bp, Homo sapiens
  misc_feature: HEFZJCU01EBIGX.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaacgggcccactcggtccttccccctggccaccctccctccaagacgcacctctgggggcacgagcggccctgggctg

SEQ ID NO: 450157 - DNA, 316 bp, Homo sapiens; identical to SEQ ID NO: 444444
  misc_feature: HEFZJCU01CR44N.47.56.F01.1.454.heavy.3.raw

SEQ ID NO: 450158 - DNA, 522 bp, Homo sapiens
  misc_feature: HEFZJCU01DOQ72.51.34.D01.1.454.heavy.3.raw
cgatcgtatacacgaccggtgctcgatttagatcgtctgtgttgggtttggggagctctgagagaggagcccagccctgggattttcaggtgttttcatttggtgatcaggactgaacagagagaactcaccatggagtttgggctgagctggctttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctccagagacaatgccaaagacacgctctatctggaagtgaagagcctgagagtcgaggacacggccgtcttttatgtgtgaaggggcgtgggacttattcttcaggaccatatttactttgta

SEQ ID NO: 450159 - DNA, 519 bp, Homo sapiens; identical to SEQ ID NO: 445330
  misc_feature: HEFZJCU01BH37B.7.78.H01.1.454.heavy.3.raw

SEQ ID NO: 450160 - DNA, 372 bp, Homo sapiens; identical to SEQ ID NO: 444513
  misc_feature: HEFZJCU01ATXBA.5.23.C01.1.454.heavy.3.raw

SEQ ID NO: 450161 - DNA, 385 bp, Homo sapiens; identical to SEQ ID NO: 444438
  misc_feature: HEFZJCU01D6F9Y.18.60.F05.1.454.heavy.3.raw

SEQ ID NO: 450162 - DNA, 499 bp, Homo sapiens
  misc_feature: HEFZJCU01DXQ2G.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctggctgcctggtcaaggactacttccagacgtatca

SEQ ID NO: 450163 - DNA, 507 bp, Homo sapiens
  misc_feature: HEFZJCU01C9NPU.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 450164 - DNA, 450 bp, Homo sapiens; identical to SEQ ID NO: 447469
  misc_feature: HEFZJCU01D1VLC.52.5.A05.1.454.heavy.3.raw

SEQ ID NO: 450165 - DNA, 524 bp, Homo sapiens
  misc_feature: HEFZJCU01EPH49.12.40.D07.1.454.heavy.3.raw
atacgacgtacacgaccggtgctcgatttagtgatagagcgtaacaacagagggctcaccatggagtttgggctgacgcgtgggttttcctcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 450166 - DNA, 475 bp, Homo sapiens
  misc_feature: HEFZJCU01B99XN.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttccccctggcgccctgctccaggacgcgacctccgacgaggcacagcggccctcgggctggcctgactcaaggactaacgttccctacgacgagta

SEQ ID NO: 450167 - DNA, 375 bp, Homo sapiens; identical to SEQ ID NO: 444442
  misc_feature: HEFZJCU01ES6TN.48.23.C01.1.454.heavy.3.raw

SEQ ID NO: 450168 - DNA, 531 bp, Homo sapiens
  misc_feature: HEFZJCU01D9HE4.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccgtggggccggggaaccctggtcaccgtctccccacccctccacccg

SEQ ID NO: 450169 - DNA, 418 bp, Homo sapiens; identical to SEQ ID NO: 446028
  misc_feature: HEFZJCU01BUW5L.16.28.C06.1.454.heavy.3.raw

SEQ ID NO: 450170 - DNA, 514 bp, Homo sapiens; identical to SEQ ID NO: 447144
  misc_feature: HEFZJCU01EK6D7.17.33.C11.1.454.heavy.3.raw

SEQ ID NO: 450171 - DNA, 479 bp, Homo sapiens
  misc_feature: HEFZJCU01E199J.14.70.G04.1.454.heavy.3.raw
cgtctagtaccacgaccggtgctcgatttagtgtagtgtgaagggaaagggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctgggggcacagcggccctgggctgcctggtcaaggactacttccgtactagacg

SEQ ID NO: 450172 - DNA, 526 bp, Homo sapiens
  misc_feature: HEFZJCU01BS63X.22.33.C11.1.454.heavy.3.raw
acatacgcgtcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgaga

SEQ ID NO: 450173 - DNA, 527 bp, Homo sapiens
  misc_feature: HEFZJCU01CPT5U.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattccaccatctccagagacaattccaagaacacgctgtttcttcaaatgaacagcctgagagccgatgacacggccgtgtattactgtgcgagagagtcggggcccacgaacgttacctacggctatggacgtcgtggggccgaaggggacccg

SEQ ID NO: 450174 - DNA, 524 bp, Homo sapiens; identical to SEQ ID NO: 446747
  misc_feature: HEFZJCU01ESGUH.12.33.C11.1.454.heavy.3.raw

SEQ ID NO: 450175 - DNA, 492 bp, Homo sapiens
  misc_feature: HEFZJCU01DXK4H.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtccttcccctggcgccctgctccaggagcacctccgagagcacagcggccctgggctgcctggtcaaggactacttcccacgagagta

SEQ ID NO: 450176 - DNA, 379 bp, Homo sapiens; identical to SEQ ID NO: 444450
  misc_feature: HEFZJCU01CV64W.47.77.G11.1.454.heavy.3.raw

SEQ ID NO: 450177 - DNA, 519 bp, Homo sapiens
  misc_feature: HEFZJCU01EENLR.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 450178 - DNA, 481 bp, Homo sapiens
  misc_feature: HEFZJCU01D8CWF.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctggctgcctggtcaaggactacttcctagagacacg

SEQ ID NO: 450179 - DNA, 482 bp, Homo sapiens; identical to SEQ ID NO: 444503
  misc_feature: HEFZJCU01CMT69.7.10.A10.1.454.heavy.3.raw

SEQ ID NO: 450180 - DNA, 409 bp, Homo sapiens; identical to SEQ ID NO: 444519
  misc_feature: HEFZJCU01AE4F5.3.41.D08.1.454.heavy.3.raw

SEQ ID NO: 450181 - DNA, 511 bp, Homo sapiens
  misc_feature: HEFZJCU01B1G8Q.16.21.B10.1.454.heavy.3.raw
  modified_base (377)..(377): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttgtggctattttaaaaggtgtccagtgtgaggtgcagctgttggagtctgggggaggcttggcacagcctggggggtccctgagattctcctgtgcagcctctggattcacctttgacagctatgccatgacctgggtccgccaggctccagggaaggggctggaatgggtctcaggtattactggtggtggttataccacatactacgcagactccgtgaagggccggttnaccatctccagagacaattccaagaacacactgtatctgcaaatgaacagcctgagagccgacgacacggccatatattactgtgcgaaagcaccggcagttagtcacccatactactttgactactggggccg

SEQ ID NO: 450182 - DNA, 463 bp, Homo sapiens; identical to SEQ ID NO: 448983
  misc_feature: HEFZJCU01E15BT.10.85.H08.1.454.heavy.3.raw

SEQ ID NO: 450183 - DNA, 513 bp, Homo sapiens; identical to SEQ ID NO: 446452
  misc_feature: HEFZJCU01EZOR3.17.33.C11.1.454.heavy.3.raw

SEQ ID NO: 450184 - DNA, 525 bp, Homo sapiens
  misc_feature: HEFZJCU01DVO9F.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattctgtgcgagagggacggactacggtgactactgggggttcgacccctggggccagggaaccctggtcaccgtctcctcagcctccaccg

SEQ ID NO: 450185 - DNA, 496 bp, Homo sapiens; identical to SEQ ID NO: 446282
  misc_feature: HEFZJCU01DXVZR.12.55.E11.1.454.heavy.3.raw

SEQ ID NO: 450186 - DNA, 491 bp, Homo sapiens
  misc_feature: HEFZJCU01CAS93.40.42.D09.1.454.heavy.3.raw
tctagcgactcacgaccggtgctcgatttagacacatacgcagggaaaggggcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaaccctggggcctcagtgaaggtttcctgcaaggcatctggatacaccttcaccaggtattttatgcactgggtgcgacaggccccgggacaagggcttgagtggatgggcataatcaacccaagtggtggtagcacaacctacacacagaagttccagggcagagtcaccgtgaccagcgacacgtccacgactacagtctacatgcaactgagcagcctgaggtctgaggacacggccgtgtattactgtgcgagagatgatactagtggtattacttaaataag

SEQ ID NO: 450187 - DNA, 499 bp, Homo sapiens
  misc_feature: HEFZJCU01ENDCS.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtc

SEQ ID NO: 450188 - DNA, 508 bp, Homo sapiens; identical to SEQ ID NO: 448191
  misc_feature: HEFZJCU01D7Q02.4.67.G01.1.454.heavy.3.raw

SEQ ID NO: 450189 - DNA, 498 bp, Homo sapiens
  misc_feature: HEFZJCU01DF3PW.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactgggggccggggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 450190 - DNA, 504 bp, Homo sapiens
  misc_feature: HEFZJCU01C5L4H.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcagtcttcccctggcgccctgctccaggagcacctcccgagagcacagcggccctgggctgcctggtcaaggactacttccagacgtatca

SEQ ID NO: 450191 - DNA, 520 bp, Homo sapiens; identical to SEQ ID NO: 448947
  misc_feature: HEFZJCU01CZ0V2.12.40.D07.1.454.heavy.3.raw

SEQ ID NO: 450192 - DNA, 497 bp, Homo sapiens
  misc_feature: HEFZJCU01EC6PZ.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggcaagggacaatggt

SEQ ID NO: 450193 - DNA, 395 bp, Homo sapiens; identical to SEQ ID NO: 447595
  misc_feature: HEFZJCU01D8VXL.16.68.G02.1.454.heavy.3.raw

SEQ ID NO: 450194 - DNA, 543 bp, Homo sapiens
  misc_feature: HEFZJCU01BXAPX.18.59.F04.1.454.heavy.3.raw
tacgagtatgcacgaccggtgctcgatttagtacacacacttagggattggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactcccctgaaagcgtcaactactactactacggtatggacctctggggccaagggacccg

SEQ ID NO: 450195 - DNA, 498 bp, Homo sapiens
  misc_feature: HEFZJCU01CQJBO.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgaccctggggccagggaaccctagtcaccgtctcctcagcctccaccaagggcccatcggtcttcccctggcgccctgctccaggagcacctccgag

SEQ ID NO: 450196 - DNA, 396 bp, Homo sapiens; identical to SEQ ID NO: 444469
  misc_feature: HEFZJCU01AKG9K.47.46.E02.1.454.heavy.3.raw

SEQ ID NO: 450197 - DNA, 523 bp, Homo sapiens
  misc_feature: HEFZJCU01D4D3C.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactacgtcggggccgagggaactctggtcaccgtctccgcacgcctccaccaacgggcccatcc

SEQ ID NO: 450198 - DNA, 511 bp, Homo sapiens
  misc_feature: HEFZJCU01EW6IV.48.76.G10.1.454.heavy.3.raw
agtatacatacacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtcggaaattattatgatgct

SEQ ID NO: 450199 - DNA, 501 bp, Homo sapiens; identical to SEQ ID NO: 445027
  misc_feature: HEFZJCU01DIDLJ.26.23.C01.1.454.heavy.3.raw

SEQ ID NO: 450200 - DNA, 329 bp, Homo sapiens
  misc_feature: HEFZJCU01DI5S1.53.44.D11.1.454.heavy.3.raw
cgcgtatacacacgaccggtgctcgatttagcgcagtacgaagggccggttcatcatgtccagagacaactccaagaacacactgtatctgcaaatgaacagcctaagagccgaggacacggccgtatattactgtgcgaagatttgggggtggcaactggagtggtttttagatccgattgactcctgggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 450201 - DNA, 395 bp, Homo sapiens
  misc_feature: HEFZJCU01DNY12.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggccctatcgagtgactatggatcccaggccctttgactcctggggccagggaaccctggtcaccgtctcctcagcctccaccaagggcccatcggtcttccccctggcgccctgctccaggagcacctccgagagcacagcggccctggactgcctggtcaaggactacttccgagtagtaca

SEQ ID NO: 450202 - DNA, 491 bp, Homo sapiens
  misc_feature: HEFZJCU01AP1KF.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggcaccctcctccaagagcacctctgggggcacagaggccctgggctgcctggtcaaggactacttccgtatctctcg

SEQ ID NO: 450203 - DNA, 479 bp, Homo sapiens; identical to SEQ ID NO: 447128
  misc_feature: HEFZJCU01B4LCA.4.37.D04.1.454.heavy.3.raw

SEQ ID NO: 450204 - DNA, 537 bp, Homo sapiens
  misc_feature: HEFZJCU01CLIAP.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaacccgtggtcaccgtctcctcagcctccaccaagggcccatcggtcttcccctcggcaccctcctccaagacg

SEQ ID NO: 450205 - DNA, 511 bp, Homo sapiens
  misc_feature: HEFZJCU01E05DA.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttagtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctgggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 450206 - DNA, 498 bp, Homo sapiens
  misc_feature: HEFZJCU01ANA8Z.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaagtggtccttacaatgaccaacatggaccctttggacacagccacatattactgtgcacaccacagggtctctactgctggctttcagtacaactggttcgaaccctggggccagggaaccctggtcagcgtctctcagcct

SEQ ID NO: 450207 - DNA, 483 bp, Homo sapiens; identical to SEQ ID NO: 444924
  misc_feature: HEFZJCU01B7BDX.10.35.D02.1.454.heavy.3.raw

SEQ ID NO: 450208 - DNA, 525 bp, Homo sapiens
  misc_feature: HEFZJCU01C0M97.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 450209 - DNA, 517 bp, Homo sapiens; identical to SEQ ID NO: 446078
  misc_feature: HEFZJCU01ENPTA.9.34.D01.1.454.heavy.3.raw

SEQ ID NO: 450210 - DNA, 395 bp, Homo sapiens
  misc_feature: HEFZJCU01DC711.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttccatactcgta

SEQ ID NO: 450211 - DNA, 500 bp, Homo sapiens; identical to SEQ ID NO: 445807
  misc_feature: HEFZJCU01EL4I1.40.81.H04.1.454.heavy.3.raw

SEQ ID NO: 450212 - DNA, 493 bp, Homo sapiens
  misc_feature: HEFZJCU01CN9DP.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtta

SEQ ID NO: 450213 - DNA, 524 bp, Homo sapiens; identical to SEQ ID NO: 445889
  misc_feature: HEFZJCU01DL01A.18.33.C11.1.454.heavy.3.raw

SEQ ID NO: 450214 - DNA, 510 bp, Homo sapiens
  misc_feature: HEFZJCU01CX5T4.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctgggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgatttttggt

SEQ ID NO: 450215 - DNA, 508 bp, Homo sapiens; identical to SEQ ID NO: 444619
  misc_feature: HEFZJCU01EE3US.3.81.H04.1.454.heavy.3.raw

SEQ ID NO: 450216 - DNA, 492 bp, Homo sapiens; identical to SEQ ID NO: 445919
  misc_feature: HEFZJCU01CO2NV.14.25.C03.1.454.heavy.3.raw

SEQ ID NO: 450217 - DNA, 522 bp, Homo sapiens
  misc_feature: HEFZJCU01ER3I8.51.37.D04.1.454.heavy.3.raw
cgatcgtatacacgaccggtgctcgatttagtagcatactgttgggtttggggctgagagaggagcccagccctgggattttcaggtgttttcatttggtgatcaggactgaacagagagaactcaccatggagtttgggctgagctggctttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaagggctggaatgggtctccactattagtggcagcggtgatgacacattctacacagactccgtgaggggccgtttcaccatctccagagacaatgccaaagacacgctctatctggaagtgaagagcctgagagtcgaggacacggccgtcttttattgtgtgaaggggcgtgggacttattcttcaggaccatattactttgacttctc

SEQ ID NO: 450218 - DNA, 500 bp, Homo sapiens
  misc_feature: HEFZJCU01DJETY.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttct

SEQ ID NO: 450219 - DNA, 491 bp, Homo sapiens; identical to SEQ ID NO: 444749
  misc_feature: HEFZJCU01D1820.11.13.B02.1.454.heavy.3.raw

SEQ ID NO: 450220 - DNA, 477 bp, Homo sapiens; identical to SEQ ID NO: 444659
  misc_feature: HEFZJCU01ESHUY.16.10.A10.1.454.heavy.3.raw

SEQ ID NO: 450221 - DNA, 314 bp, Homo sapiens
  misc_feature: HEFZJCU01DC7OT.13.17.B06.1.454.heavy.3.raw
tcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttcccctggcgccctgctccaggagcacctccgagagcacagcggccctgggctgcctggtcaaggactacttcctagtacgtga

SEQ ID NO: 450222 - DNA, 522 bp, Homo sapiens
  misc_feature: HEFZJCU01BHXKZ.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacgggccgtatattactgtgcgagaataacccgttcgcctggttatttacc

SEQ ID NO: 450223 - DNA, 410 bp, Homo sapiens; identical to SEQ ID NO: 444689
  misc_feature: HEFZJCU01CWDLO.52.87.H10.1.454.heavy.3.raw

SEQ ID NO: 450224 - DNA, 400 bp, Homo sapiens; identical to SEQ ID NO: 444452
  misc_feature: HEFZJCU01DT5I7.47.24.C02.1.454.heavy.3.raw

SEQ ID NO: 450225 - DNA, 485 bp, Homo sapiens
  misc_feature: HEFZJCU01BDATV.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctgggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactacctatg

SEQ ID NO: 450226 - DNA, 500 bp, Homo sapiens; identical to SEQ ID NO: 445028
  misc_feature: HEFZJCU01AVWO9.13.12.B01.1.454.heavy.3.raw

SEQ ID NO: 450227 - DNA, 500 bp, Homo sapiens
  misc_feature: HEFZJCU01CWRRV.26.23.C01.1.454.heavy.3.raw
agactatactcacgaccggtgctcgatttagtacacgtgattagggattgggaggcgtggtccagcctggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 450228 - DNA, 496 bp, Homo sapiens
  misc_feature: HEFZJCU01DJE3T.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagagtgactacgggggcgttcg

SEQ ID NO: 450229 - DNA, 529 bp, Homo sapiens
  misc_feature: HEFZJCU01D64IW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatccggtcttccccctggccgccctcg

SEQ ID NO: 450230 - DNA, 457 bp, Homo sapiens
  misc_feature: HEFZJCU01DBVNF.7.34.D01.1.454.heavy.3.raw
  modified_base (450)..(450): a, c, t, g, unknown or other
cgtgtctctacacgaccggtgctcgatttagatcgtctgtgttgggtttgggattcacgttgcagatgtaggtctgggtgcgccagatgcccgggaaaggcctggagtggatggggagcatctatcctggtgactctgataccagatacagcccgtccttccaaggccacgtcaccatctcgctcgacaagtccatcaccaccgcctacgtggagtggagcagcctgaaggcctcggacaccgcaatgtattactgtgcgaaactcgaccgagattgtcgtggtggcaggtgcttctcggaaaaattcgagtcctgggccagggaaccccggtcagtgtctcctcagcctccaccaagggcccatcggtcttccccctggcaccctcctccaagagcacctctgggggcacagcggccctgggctgcctggtcaaggactaacttcctanagacacg

SEQ ID NO: 450231 - DNA, 503 bp, Homo sapiens
  misc_feature: HEFZJCU01ET3YZ.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcgactctgtgaagggccgattcaccatctccagagacaacgccaagaactccctgtatctgcaaatgaaacagcctgagaggctgaggacacggccttgtattattgtgcaaaagatccaaccccttacgta

SEQ ID NO: 450232 - DNA, 502 bp, Homo sapiens
  misc_feature: HEFZJCU01C2166.48.34.D01.1.454.heavy.3.raw
agtatacatacacgaccggtgctcgatttagatcgtctgtgttagggtgcaaggttggtggagtcggggggacggtgtggtaccagcctgggaagtccctgacactgtccctgcgcagcctctggattcaccttcaccacctttcggtatgccacttttgttccggccaggctccaggccaaggggcgtggacgtgggtcggctgttagtgtcaaatgatggacgatgctgaatatgcgacgactccgtgaagggggccgatttcggccttactccctagaggacaattccaagtagcacggttcatctgcaaatgagcgccctgagacctgacgacacggctgtctattactgtgcgagagggcgtccgagtttacacgccgtcggagggatattactttgacaactggggccagggaaccctggtcaccggtctcctcagcctccaccaagggcccatcggtcttcccctggcgccctgctccaggagctacctccgaga

SEQ ID NO: 450233 - DNA, 527 bp, Homo sapiens
  misc_feature: HEFZJCU01ECULV.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggttgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaac

SEQ ID NO: 450234 - DNA, 495 bp, Homo sapiens
  misc_feature: HEFZJCU01E0KIB.26.78.H01.1.454.heavy.3.raw
agactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagagatgacgatgtacagtgggaactaccctgatgctttcgatatctgggggccaagggacaatggtcaccgtctcttcagcctccaccaagggcccatcggtccttcccctggccaccctcct

SEQ ID NO: 450235 - DNA, 515 bp, Homo sapiens
  misc_feature: HEFZJCU01C6E86.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacccacggccatatattactgtgcgaaagcaccggcagttagtcacccatactactttgactacgtggggccaac

SEQ ID NO: 450236 - DNA, 391 bp, Homo sapiens; identical to SEQ ID NO: 444514
  misc_feature: HEFZJCU01D7HC3.12.24.C02.1.454.heavy.3.raw

SEQ ID NO: 450237 - DNA, 500 bp, Homo sapiens; identical to SEQ ID NO: 445720
  misc_feature: HEFZJCU01A9E7N.3.20.B09.1.454.heavy.3.raw

SEQ ID NO: 450238 - DNA, 503 bp, Homo sapiens
  misc_feature: HEFZJCU01AE9E2.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctccctcagcctccaccaagggcccatcggtcttcccctcggcgccctgctccaggagcacctccgagagcacagcggccctgggctgcctggtcaaggactacttcctatgtatact

SEQ ID NO: 450239 - DNA, 489 bp, Homo sapiens; identical to SEQ ID NO: 444791
  misc_feature: HEFZJCU01BU0FE.47.85.H08.1.454.heavy.3.raw

SEQ ID NO: 450240 - DNA, 379 bp, Homo sapiens; identical to SEQ ID NO: 444450
  misc_feature: HEFZJCU01ATR9F.47.77.G11.1.454.heavy.3.raw

SEQ ID NO: 450241 - DNA, 507 bp, Homo sapiens
  misc_feature: HEFZJCU01CU07Z.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtacctcggatggtttgt

SEQ ID NO: 450242 - DNA, 536 bp, Homo sapiens
  misc_feature: HEFZJCU01E0MQ7.52.14.B03.1.454.heavy.3.raw
cgcagtacgacacgaccggtgctcgatttagtgtgagtagttccgcggggctttctgagagtcatggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtgtcttttatagtggaaacacctactacaacccgtccctcaagagtcgagtcaccatatcagtagacacgtccaagagccagttctccctgaagctgacgtctctgaacgccgcggacacggccgtttattactgtgcgagtaccccggaacctttttacgatttttggagtggatactataccggtatggggccttttgactttctggggccagggaaccctggtcaccgtctcctcag

SEQ ID NO: 450243 - DNA, 499 bp, Homo sapiens
  misc_feature: HEFZJCU01D1170.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggccctttattactgtgcgagatttaccgtgggggtcacggcggatatatcgccata

SEQ ID NO: 450244 - DNA, 468 bp, Homo sapiens
  misc_feature: HEFZJCU01C6H29.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctcaccaagggcccatcggtcttcccctggcgccctgctccaggagcacctccgagagcacagcggccctggctgcctgtcaaggactacttccctacagtgct

SEQ ID NO: 450245 - DNA, 509 bp, Homo sapiens
  misc_feature: HEFZJCU01C68LQ.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcggtcttcccctggc

SEQ ID NO: 450246 - DNA, 490 bp, Homo sapiens; identical to SEQ ID NO: 446494
  misc_feature: HEFZJCU01D1LC2.11.13.B02.1.454.heavy.3.raw

SEQ ID NO: 450247 - DNA, 528 bp, Homo sapiens
  misc_feature: HEFZJCU01BWJRY.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatggaaccccggtcaccgt

SEQ ID NO: 450248 - DNA, 513 bp, Homo sapiens
  misc_feature: HEFZJCU01DYSWU.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtctggacg

SEQ ID NO: 450249 - DNA, 400 bp, Homo sapiens; identical to SEQ ID NO: 444452
  misc_feature: HEFZJCU01BZNO4.47.24.C02.1.454.heavy.3.raw

SEQ ID NO: 450250 - DNA, 517 bp, Homo sapiens
  misc_feature: HEFZJCU01CD59Y.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattgggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactgggggccaggggagccctgggtcaccgtctcctcacg

SEQ ID NO: 450251 - DNA, 502 bp, Homo sapiens
  misc_feature: HEFZJCU01EU02P.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagattggggcggaaggtatagca

SEQ ID NO: 450252 - DNA, 524 bp, Homo sapiens
  misc_feature: HEFZJCU01C8FNK.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctccttgacttctgggccatggaacccggtcc

SEQ ID NO: 450253 - DNA, 514 bp, Homo sapiens
  misc_feature: HEFZJCU01A5DC0.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatgg

SEQ ID NO: 450254 - DNA, 373 bp, Homo sapiens; identical to SEQ ID NO: 445918
  misc_feature: HEFZJCU01CGHXF.49.30.C08.1.454.heavy.3.raw

SEQ ID NO: 450255 - DNA, 400 bp, Homo sapiens
  misc_feature: HEFZJCU01EVZQ0.47.41.D08.1.454.heavy.3.raw
agctcacgtacacgaccggtgctcgatttagtcacgcgagaaagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 450256 - DNA, 519 bp, Homo sapiens
  misc_feature: HEFZJCU01C56IW.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttccccctggcaccctcctccaagagcacctctgggggcacagcggccctgggctgcctggtcaaggactacttccgagtagtacac

SEQ ID NO: 450257 - DNA, 475 bp, Homo sapiens
  misc_feature: HEFZJCU01DAZEV.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccgaggtgcagctggtgcagtctggggctgaggtgaaggagcctggggcctcagtgaaggtctcctgcaaggcttctggatacaccttcaccggctactatttgcactggctacgacaggcccctggacaagggcttgagtggatgggatggatctatcctaccagtggtggcacacgctattcacagaagtttcagggcagggtcaccatgaccagggacacgtccatcagcacagcctacatggaattgagcagggctgacatctgacgacacggccgtgtattattgtgcgagagcctc

SEQ ID NO: 450258 - DNA, 392 bp, Homo sapiens; identical to SEQ ID NO: 444682
  misc_feature: HEFZJCU01EU7TL.16.70.G04.1.454.heavy.3.raw

SEQ ID NO: 450259 - DNA, 506 bp, Homo sapiens; identical to SEQ ID NO: 444696
  misc_feature: HEFZJCU01BTNAP.16.34.D01.1.454.heavy.3.raw

SEQ ID NO: 450260 - DNA, 482 bp, Homo sapiens
  misc_feature: HEFZJCU01EKKFC.49.4.A04.1.454.heavy.3.raw
agtcgagagacacgaccggtgctcgatttagagtagtgatcagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatatttactgtgcgaacttatca

SEQ ID NO: 450261 - DNA, 483 bp, Homo sapiens
  misc_feature: HEFZJCU01A71G2.49.8.A08.1.454.heavy.3.raw
agtcgagagacacgaccggtgctcgatttagcatactctacaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaaggggcgattcatcatctccagagacaattccgagaacacgctgtatctgcaaatgaacagcctgagagctggaggacacggctgtgtattactgtgcgaacttaatcacgga

SEQ ID NO: 450262 - DNA, 396 bp, Homo sapiens; identical to SEQ ID NO: 444469
  misc_feature: HEFZJCU01BIHQE.47.46.E02.1.454.heavy.3.raw

SEQ ID NO: 450263 - DNA, 500 bp, Homo sapiens; identical to SEQ ID NO: 447775
  misc_feature: HEFZJCU01ERBSJ.10.34.D01.1.454.heavy.3.raw

SEQ ID NO: 450264 - DNA, 508 bp, Homo sapiens
  misc_feature: HEFZJCU01BFDGQ.52.86.H09.1.454.heavy.3.raw
cgcagtacgacacgaccggtgctcgatttagtgctatagacttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccagtcggtcttcccccg

SEQ ID NO: 450265 - DNA, 523 bp, Homo sapiens; identical to SEQ ID NO: 448275
  misc_feature: HEFZJCU01BE8B9.12.40.D07.1.454.heavy.3.raw

SEQ ID NO: 450266 - DNA, 491 bp, Homo sapiens
  misc_feature: HEFZJCU01BIKCL.53.26.C04.1.454.heavy.3.raw
cgcgtatacacacgaccggtgctcgatttagtctagcgactttgggtttggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatgacctc

SEQ ID NO: 450267 - DNA, 466 bp, Homo sapiens
  misc_feature: HEFZJCU01D8Y5Z.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcggcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 450268 - DNA, 324 bp, Homo sapiens; identical to SEQ ID NO: 444475
  misc_feature: HEFZJCU01BCVZA.18.17.B06.1.454.heavy.3.raw

SEQ ID NO: 450269 - DNA, 535 bp, Homo sapiens
  misc_feature: HEFZJCU01C2DYK.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagtttatgggttggggggagttggggttttttttcgttacgttacggggt

SEQ ID NO: 450270 - DNA, 490 bp, Homo sapiens
  misc_feature: HEFZJCU01BXNQT.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgaggta

SEQ ID NO: 450271 - DNA, 379 bp, Homo sapiens; identical to SEQ ID NO: 444450
  misc_feature: HEFZJCU01DVZ31.47.77.G11.1.454.heavy.3.raw

SEQ ID NO: 450272 - DNA, 478 bp, Homo sapiens; identical to SEQ ID NO: 448105
  misc_feature: HEFZJCU01DHHZD.26.78.H01.1.454.heavy.3.raw

SEQ ID NO: 450273 - DNA, 528 bp, Homo sapiens
  misc_feature: HEFZJCU01B7048.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaaccccttggctactggggccagggaaccctggtcaccgtctcttcagcctccaccaagggccc

SEQ ID NO: 450274 - DNA, 539 bp, Homo sapiens
  misc_feature: HEFZJCU01BG8L5.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggccaccct

SEQ ID NO: 450275 - DNA, 496 bp, Homo sapiens
  misc_feature: HEFZJCU01EW9PH.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattac

SEQ ID NO: 450276 - DNA, 512 bp, Homo sapiens
  misc_feature: HEFZJCU01DZPVJ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggggccg

SEQ ID NO: 450277 - DNA, 379 bp, Homo sapiens
  misc_feature: HEFZJCU01BQM0F.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgggagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 450278 - DNA, 490 bp, Homo sapiens
  misc_feature: HEFZJCU01BZD0N.52.6.A06.1.454.heavy.3.raw
cgcagtacgacacgaccggtgctcgatttagatctactgacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcaagggactggagtgggtggcagttatatcagctgatggaggcaataagtattacgcagattctgcgaggggccggattcaccatatccagagacaactcccaagatatgatatatctgcaaatgaacagcctgagacctgaggacacggccatatattattgtgcgtcagggggcaggtgtccg

SEQ ID NO: 450279 - DNA, 507 bp, Homo sapiens
  misc_feature: HEFZJCU01EISIU.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggccatcggtctcccctggc

SEQ ID NO: 450280 - DNA, 511 bp, Homo sapiens; identical to SEQ ID NO: 446799
  misc_feature: HEFZJCU01DJOU4.18.39.D06.1.454.heavy.3.raw

SEQ ID NO: 450281 - DNA, 512 bp, Homo sapiens
  misc_feature: HEFZJCU01EC3JV.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccgagcgggagtccaagtactcctttgacgtc

SEQ ID NO: 450282 - DNA, 487 bp, Homo sapiens
  misc_feature: HEFZJCU01AIDBE.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgcccgagtactggggccgcggaatcttggtcaccgtctcctcagcctccaccaagggcccatcggtcttcccctggcgccctgctccaggagcacctccgagagcacagcggccctgggctgcctggtcaaggactacttccctacagtgct

SEQ ID NO: 450283 - DNA, 477 bp, Homo sapiens
  misc_feature: HEFZJCU01BK6H6.51.76.G10.1.454.heavy.3.raw
cgatcgtatacacgaccggtgctcgatttagtcactcatacaggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacactgtatctgcaaatgaacagattgagagctgaggacacggctgtgtatttctgtgcgaacgcta

SEQ ID NO: 450284 - DNA, 505 bp, Homo sapiens; identical to SEQ ID NO: 445122
  misc_feature: HEFZJCU01ERORY.49.31.C09.1.454.heavy.3.raw

SEQ ID NO: 450285 - DNA, 507 bp, Homo sapiens
  misc_feature: HEFZJCU01EV7S9.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattacttgtgcgcgacatgactacgctcaattctggggccagggacg

SEQ ID NO: 450286 - DNA, 523 bp, Homo sapiens
  misc_feature: HEFZJCU01CD2YH.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctgtcaaggactacttcc

SEQ ID NO: 450287 - DNA, 500 bp, Homo sapiens; identical to SEQ ID NO: 444529
  misc_feature: HEFZJCU01AEO90.12.38.D05.1.454.heavy.3.raw

SEQ ID NO: 450288 - DNA, 483 bp, Homo sapiens
  misc_feature: HEFZJCU01CTSQK.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatacg

SEQ ID NO: 450289 - DNA, 511 bp, Homo sapiens
  misc_feature: HEFZJCU01DLLI1.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggcctgggctgcctggtcaaggactacttccgagtgcgtct

SEQ ID NO: 450290 - DNA, 508 bp, Homo sapiens; identical to SEQ ID NO: 444619
  misc_feature: HEFZJCU01BQDNG.3.81.H04.1.454.heavy.3.raw

SEQ ID NO: 450291 - DNA, 396 bp, Homo sapiens; identical to SEQ ID NO: 444426
  misc_feature: HEFZJCU01BPSCR.18.31.C09.1.454.heavy.3.raw

SEQ ID NO: 450292 - DNA, 324 bp, Homo sapiens; identical to SEQ ID NO: 445178
  misc_feature: HEFZJCU01DMNPG.18.17.B06.1.454.heavy.3.raw

SEQ ID NO: 450293 - DNA, 518 bp, Homo sapiens
  misc_feature: HEFZJCU01DY07W.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggaccaac

SEQ ID NO: 450294 - DNA, 525 bp, Homo sapiens; identical to SEQ ID NO: 448355
  misc_feature: HEFZJCU01A6Y2A.49.34.D01.1.454.heavy.3.raw

SEQ ID NO: 450295 - DNA, 403 bp, Homo sapiens; identical to SEQ ID NO: 444540
  misc_feature: HEFZJCU01EBV1L.16.72.G06.1.454.heavy.3.raw

SEQ ID NO: 450296 - DNA, 502 bp, Homo sapiens; identical to SEQ ID NO: 445414
  misc_feature: HEFZJCU01EGMLF.17.25.C03.1.454.heavy.3.raw

SEQ ID NO: 450297 - DNA, 495 bp, Homo sapiens
  misc_feature: HEFZJCU01AOF3B.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggctttttcttaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaagatttggggaatgaccacgtc

SEQ ID NO: 450298 - DNA, 519 bp, Homo sapiens
  misc_feature: HEFZJCU01EMEXZ.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatcggtcttcccctggcaccctcctccaagagcacctctgggggcacacg

SEQ ID NO: 450299 - DNA, 524 bp, Homo sapiens
  misc_feature: HEFZJCU01AGS46.8.25.C03.1.454.heavy.3.raw
ctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctgggccagggaaccctggtcaccgtctcctcagcctccaccaagggcccatcggtcttcccctggcgccctgctccaggagcacctccgagagcacagcggccctgggctgcct

SEQ ID NO: 450300 - DNA, 507 bp, Homo sapiens
  misc_feature: HEFZJCU01AUHIY.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggacgacatgacaccg

SEQ ID NO: 450301 - DNA, 511 bp, Homo sapiens
  misc_feature: HEFZJCU01CAH3K.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagttccaagtactcctttg

SEQ ID NO: 450302 - DNA, 500 bp, Homo sapiens
  misc_feature: HEFZJCU01DSQZJ.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgtcctttgtatatgtgggccgaaggacaatggtcaccgtct

SEQ ID NO: 450303 - DNA, 427 bp, Homo sapiens; identical to SEQ ID NO: 444708
  misc_feature: HEFZJCU01DSA4I.9.34.D01.1.454.heavy.3.raw

SEQ ID NO: 450304 - DNA, 519 bp, Homo sapiens; identical to SEQ ID NO: 445330
  misc_feature: HEFZJCU01BITOE.7.78.H01.1.454.heavy.3.raw

SEQ ID NO: 450305 - DNA, 522 bp, Homo sapiens; identical to SEQ ID NO: 446788
  misc_feature: HEFZJCU01EAWXE.12.40.D07.1.454.heavy.3.raw

SEQ ID NO: 450306 - DNA, 501 bp, Homo sapiens
  misc_feature: HEFZJCU01AIAS3.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccactggggccg

SEQ ID NO: 450307 - DNA, 499 bp, Homo sapiens; identical to SEQ ID NO: 447326
  misc_feature: HEFZJCU01C8MW3.40.81.H04.1.454.heavy.3.raw

SEQ ID NO: 450308 - DNA, 502 bp, Homo sapiens
  misc_feature: HEFZJCU01CBSER.10.38.D05.1.454.heavy.3.raw
catagtagtgcacgaccggtgctcgatttagtatctgatagttgggtttgcggggagaggagcccagcactgggattccgaggtgtttccattcggtgatcagcactgaacacagaggactcaccatggagttttggctgagcgtggttttccgttgttaggctatttctaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggcca

SEQ ID NO: 450309 - DNA, 485 bp, Homo sapiens
  misc_feature: HEFZJCU01DTY8F.12.40.D07.1.454.heavy.3.raw
  modified_base (436)..(436): a, c, t, g, unknown or other
  modified_base (484)..(484): a, c, t, g, unknown or other
atacgacgtacacgaccggtgctcgatttagtgatagagcgtaacaacagaggactcaccatggagtttgggctgagcgtggtttcgtcgtaggctctttaagtaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttcccctggcgccctgctccaggagcacctccgagngcacagcggccctgggctgcctggtcaaggactacttcctacgtcgtnt

SEQ ID NO: 450310 - DNA, 470 bp, Homo sapiens
  misc_feature: HEFZJCU01D8KQ8.49.10.A10.1.454.heavy.3.raw
agtcgagagacacgaccggtgctcgatttagcgtcgatctcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttccaggagcgatcatactactttgaccactggggccagggaaccctggtcaccgtctcctcagcctccaccaagggcccatcggtcttccccctcggcaccctcctccaagagcacctctgggggcacagcggccctgggctgcctggtcaaggactacttcctctctcgact

SEQ ID NO: 450311 - DNA, 531 bp, Homo sapiens
  misc_feature: HEFZJCU01A2ZYE.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctgggccagggaaccctggtcaccgtctcctcagcctccaccaacggcccatcggtcttccccctggccgccctcgcctccacggagcaccgtccgacgacg

SEQ ID NO: 450312 - DNA, 498 bp, Homo sapiens
  misc_feature: HEFZJCU01DHA6S.11.71.G05.1.454.heavy.3.raw
  modified_base (479)..(479): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagntttctatagaggtgactac

SEQ ID NO: 450313 - DNA, 520 bp, Homo sapiens
  misc_feature: HEFZJCU01C8847.52.78.H01.1.454.heavy.3.raw
cgcagtacgacacgaccggtgctcgatttagtgtgagtagtttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccaggggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacgggccgtgtattacgtgtgacgaggtcgtttcgttaggtagttgttcgttcgttcgccaacg

SEQ ID NO: 450314 - DNA, 320 bp, Homo sapiens; identical to SEQ ID NO: 445022
  misc_feature: HEFZJCU01CQQN0.14.28.C06.1.454.heavy.3.raw

SEQ ID NO: 450315 - DNA, 494 bp, Homo sapiens
  misc_feature: HEFZJCU01D90B1.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctattgactactggggccagggaaccctggtcaccgtctcctcagcctccaccaagggcccatcggtcttcccctggcaccctcctccaagagcacctctgggggcacagcggcctgggctgcctggtcaaggactacttccgagtagtaca

SEQ ID NO: 450316 - DNA, 515 bp, Homo sapiens
  misc_feature: HEFZJCU01C84VD.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactgggccgggaacctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 450317 - DNA, 531 bp, Homo sapiens
  misc_feature: HEFZJCU01EYE1F.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaacgggcccatcggtcttcccctcggccgccctgcctccaggagcacctccgagacg

SEQ ID NO: 450318 - DNA, 524 bp, Homo sapiens; identical to SEQ ID NO: 445902
  misc_feature: HEFZJCU01CQP1X.9.78.H01.1.454.heavy.3.raw

SEQ ID NO: 450319 - DNA, 536 bp, Homo sapiens
  misc_feature: HEFZJCU01DQO83.51.49.E05.1.454.heavy.3.raw
cgatcgtatacacgaccggtgctcgatttagagcgactagcaacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagcccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatgggacgtctggggcgcgagggaccacggtcgccgtctcttcggcctccaccaagggccc

SEQ ID NO: 450320 - DNA, 505 bp, Homo sapiens
  misc_feature: HEFZJCU01A3YYA.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggtccgcggtccggg

SEQ ID NO: 450321 - DNA, 520 bp, Homo sapiens
  misc_feature: HEFZJCU01EN3IZ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagagcacctctgggggcacagcggccctgggctgcctggtcaaggactacttccagacgtatca

SEQ ID NO: 450322 - DNA, 492 bp, Homo sapiens; identical to SEQ ID NO: 447005
  misc_feature: HEFZJCU01BDCWF.53.26.C04.1.454.heavy.3.raw

SEQ ID NO: 450323 - DNA, 509 bp, Homo sapiens; identical to SEQ ID NO: 444586
  misc_feature: HEFZJCU01CJXXN.12.78.H01.1.454.heavy.3.raw

SEQ ID NO: 450324 - DNA, 504 bp, Homo sapiens; identical to SEQ ID NO: 445648
  misc_feature: HEFZJCU01EWRIM.17.25.C03.1.454.heavy.3.raw

SEQ ID NO: 450325 - DNA, 488 bp, Homo sapiens
  misc_feature: HEFZJCU01DF44A.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctccgagagcacagcggccctgggctgcctggtcaaggactacttcccactactatg

SEQ ID NO: 450326 - DNA, 489 bp, Homo sapiens; identical to SEQ ID NO: 444791
  misc_feature: HEFZJCU01AF7V2.47.85.H08.1.454.heavy.3.raw

SEQ ID NO: 450327 - DNA, 379 bp, Homo sapiens; identical to SEQ ID NO: 444450
  misc_feature: HEFZJCU01ELM0S.47.77.G11.1.454.heavy.3.raw

SEQ ID NO: 450328 - DNA, 507 bp, Homo sapiens; identical to SEQ ID NO: 445781
  misc_feature: HEFZJCU01C8PZQ.48.44.D11.1.454.heavy.3.raw

SEQ ID NO: 450329 - DNA, 530 bp, Homo sapiens
  misc_feature: HEFZJCU01D23FL.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaaccccggtcaccgt

SEQ ID NO: 450330 - DNA, 508 bp, Homo sapiens; identical to SEQ ID NO: 446002
  misc_feature: HEFZJCU01AL2PC.9.78.H01.1.454.heavy.3.raw

SEQ ID NO: 450331 - DNA, 516 bp, Homo sapiens
  misc_feature: HEFZJCU01ELS3T.48.38.D05.1.454.heavy.3.raw
agtatacatacacgaccggtgctcgatttagtatctgatagttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtata

SEQ ID NO: 450332 - DNA, 512 bp, Homo sapiens
  misc_feature: HEFZJCU01DKNPQ.52.78.H01.1.454.heavy.3.raw
  modified_base (491)..(491): a, c, t, g, unknown or other
cgcagtacgacacgaccggtgctcgatttagtgtgagtagtttgggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcnccctcctccaagagcacctcg

SEQ ID NO: 450333 - DNA, 529 bp, Homo sapiens
  misc_feature: HEFZJCU01D3SUI.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgttgcgagagccctcggcagaagtctggactactactattatggtatggacgtctggggccaagggaccacggtcatcgtctcctcagcctccaccaagggcccatccggtcttccccctcggcaccctcctccaagagcacctctgggggcacgagcc

SEQ ID NO: 450334 - DNA, 499 bp, Homo sapiens
  misc_feature: HEFZJCU01BM2H0.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgacccctggggccagggaacctggtcaccgtctcctc

SEQ ID NO: 450335 - DNA, 506 bp, Homo sapiens
  misc_feature: HEFZJCU01B7J9Y.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctcccaagagcacctctgggggcacagcggccctgggctgcctggtcaaggactacttccgagtagtaca

SEQ ID NO: 450336 - DNA, 519 bp, Homo sapiens
  misc_feature: HEFZJCU01EVY3T.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggggaactcgtggtcaccgtctccgcagcctccaccaagggcccatcc

SEQ ID NO: 450337 - DNA, 484 bp, Homo sapiens
  misc_feature: HEFZJCU01DQITW.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaggcccatcggtcttcccctggcgccctgctccaggagcacctccgagagcacagcggccctgggctgcctggtcaggactacttcccatacgta

SEQ ID NO: 450338 - DNA, 530 bp, Homo sapiens
  misc_feature: HEFZJCU01CSMUY.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtgggggccaggggaaccctggtcaccgtctcctcagcctccaaccg

SEQ ID NO: 450339 - DNA, 522 bp, Homo sapiens
  misc_feature: HEFZJCU01DY4PS.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgcctgctccagagcacctccgagagcacagcggccctggg

SEQ ID NO: 450340 - DNA, 516 bp, Homo sapiens; identical to SEQ ID NO: 445437
  misc_feature: HEFZJCU01BKXKV.26.71.G05.1.454.heavy.3.raw

SEQ ID NO: 450341 - DNA, 467 bp, Homo sapiens; identical to SEQ ID NO: 444941
  misc_feature: HEFZJCU01E0TYH.16.78.H01.1.454.heavy.3.raw

SEQ ID NO: 450342 - DNA, 488 bp, Homo sapiens
  misc_feature: HEFZJCU01AMIF5.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtgcgtttattcgaagcgatgggactcatgaacaatatgcagactccgtgaagggccgattcatcatctccagagacaactccaacaacacactggatctccaaatgaacagcctgagagtcgaggacacggccgtatattattgtcgcccttgacttacta

SEQ ID NO: 450343 - DNA, 517 bp, Homo sapiens
  misc_feature: HEFZJCU01DYM10.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttggttttggggcctcgggggctactggggccagggaaccatggtcaccgtctcctcagcctccaccaagggcccatcggtcttcccctggcaccctcctccaagagcacctctgggggcacagcggccctgggctgcctggtcaaggactacttcctgtcgagcgt

SEQ ID NO: 450344 - DNA, 523 bp, Homo sapiens
  misc_feature: HEFZJCU01AP0CR.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatggggccaggggacagcgggtcaccgtctcttcag

SEQ ID NO: 450345 - DNA, 396 bp, Homo sapiens; identical to SEQ ID NO: 444426
  misc_feature: HEFZJCU01D7F21.18.31.C09.1.454.heavy.3.raw

SEQ ID NO: 450346 - DNA, 513 bp, Homo sapiens; identical to SEQ ID NO: 447280
  misc_feature: HEFZJCU01C02CR.19.26.C04.1.454.heavy.3.raw

SEQ ID NO: 450347 - DNA, 542 bp, Homo sapiens
  misc_feature: HEFZJCU01BQF4N.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcgaaagtgcatcgacgtaaaggaggctatgcttttgatatctggggcccagggacaa

SEQ ID NO: 450348 - DNA, 504 bp, Homo sapiens
  misc_feature: HEFZJCU01D7NK4.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctgggccaagggacactggtcaccgtctcttcagcctccaccaagggcccatcggtcttcccctggcgcctgctccaggacg

SEQ ID NO: 450349 - DNA, 528 bp, Homo sapiens
  misc_feature: HEFZJCU01AYP7F.16.71.G05.1.454.heavy.3.raw
tgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctcgggcgtgccgtcggtcgtaacggaacgtaccttaccgtacgtaggtactaactcgaggcgggcggtggcgaaggacggccgactaa

SEQ ID NO: 450350 - DNA, 496 bp, Homo sapiens
  misc_feature: HEFZJCU01AGI9J.16.37.D04.1.454.heavy.3.raw
  modified_base (339)..(339): a, c, t, g, unknown or other
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtnactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 450351 - DNA, 495 bp, Homo sapiens
  misc_feature: HEFZJCU01BMKS3.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggcccgtggctgcctggtcaaggactac

SEQ ID NO: 450352 - DNA, 461 bp, Homo sapiens
  misc_feature: HEFZJCU01DMF5J.4.6.A06.1.454.heavy.3.raw
agcactgtagcacgaccggtgctcgatttagatctactgacagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgcttttgatatctggggccaagggacaatggtcaccgtctcttcagcctccaccaagggcccatcggtcttcccctggcaccctcctccaagagcacctctgggggcacagcggccctgggctgcctggtcaaggactacttccctacagtgct

SEQ ID NO: 450353 - DNA, 511 bp, Homo sapiens
  misc_feature: HEFZJCU01DORXD.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctattttgtccggtggttcgaccctggggccagggaccctggtcaccgtctcctc

SEQ ID NO: 450354 - DNA, 504 bp, Homo sapiens; identical to SEQ ID NO: 445222
  misc_feature: HEFZJCU01BZIQ4.9.33.C11.1.454.heavy.3.raw

SEQ ID NO: 450355 - DNA, 389 bp, Homo sapiens
  misc_feature: HEFZJCU01DTSME.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaggactacttccgagtagtaca

SEQ ID NO: 450356 - DNA, 517 bp, Homo sapiens
  misc_feature: HEFZJCU01C2S7K.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccgggagatcatgagggtgtccttgggttttggggcctcgggggctactggggccagggaaccatggtcaccgtctcctcagcctccaccaagggcccatcggtcttccccctggcaccctcctccaagagcacctctgggggcacagcggccctgggctgcctggtcaaggactacttcctgtcgagcg

SEQ ID NO: 450357 - DNA, 518 bp, Homo sapiens
  misc_feature: HEFZJCU01EOH5I.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgatca

SEQ ID NO: 450358 - DNA, 519 bp, Homo sapiens; identical to SEQ ID NO: 446650
  misc_feature: HEFZJCU01COCXR.13.76.G10.1.454.heavy.3.raw

SEQ ID NO: 450359 - DNA, 503 bp, Homo sapiens
  misc_feature: HEFZJCU01DW7WB.48.23.C01.1.454.heavy.3.raw
agtatacatacacgaccggtgctcgatttagtacacgtgattagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgagccccgagcgcagtggcttttgatgcctttgatatgtggggccaagggacaagtggtcaccgt

SEQ ID NO: 450360 - DNA, 519 bp, Homo sapiens; identical to SEQ ID NO: 444867
  misc_feature: HEFZJCU01D9U7I.9.34.D01.1.454.heavy.3.raw

SEQ ID NO: 450361 - DNA, 397 bp, Homo sapiens
  misc_feature: HEFZJCU01DCSJC.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggccgccctgctccaggagcacctccgagagcacagcggccctgggctgcctggtcaaggactacttcctacgtgagct

SEQ ID NO: 450362 - DNA, 493 bp, Homo sapiens
  misc_feature: HEFZJCU01BUEE3.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggccgccctgctccaggagcacctccgagagcacagccggccctgggctgcctggtcaaggactacttcccacgagagta

SEQ ID NO: 450363 - DNA, 375 bp, Homo sapiens
  misc_feature: HEFZJCU01CBLDF.48.59.F04.1.454.heavy.3.raw
agtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgactttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 450364 - DNA, 421 bp, Homo sapiens
  misc_feature: HEFZJCU01EPGMQ.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaa

SEQ ID NO: 450365 - DNA, 471 bp, Homo sapiens
  misc_feature: HEFZJCU01COC81.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggcccgtgggctgcctggtcaaggactacttccctacagtgct

SEQ ID NO: 450366 - DNA, 524 bp, Homo sapiens
  misc_feature: HEFZJCU01B655S.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatccggtcttccccctggcg

SEQ ID NO: 450367 - DNA, 411 bp, Homo sapiens
  misc_feature: HEFZJCU01DGBZE.3.41.D08.1.454.heavy.3.raw
agacgcactccacgaccggtgctcgatttagtcacgcgagaaagggaaaggggcgtggaatgggttgcatacatttcaagtagtggttccaccatacattatgcagactctgtgaagggccgattcaccgtctcctagagacaacgcccagaactcactgtctctacaaatgaacagcctgagacccgaggacacggctgtttattactgtgcgagagaaacttacgagtttttggagtggttattatactccccgggatcttgactactggggccaggggaccctggtcaccgtctcctcagcttccaccaagggcccatcggtcttcccctggcgccctgctccaggagcacctctgggggcacagcggccctgggctgcctggtcaaggactacttccgagtgcgtct

SEQ ID NO: 450368 - DNA, 495 bp, Homo sapiens; identical to SEQ ID NO: 445359
  misc_feature: HEFZJCU01DFJIX.4.21.B10.1.454.heavy.3.raw

SEQ ID NO: 450369 - DNA, 518 bp, Homo sapiens
  misc_feature: HEFZJCU01DNTBT.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctgggctgcctggtcaaggactacttcctagagacacg

SEQ ID NO: 450370 - DNA, 495 bp, Homo sapiens
  misc_feature: HEFZJCU01E0S39.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaggactacttccgagtagtaca

SEQ ID NO: 450371 - DNA, 537 bp, Homo sapiens
  misc_feature: HEFZJCU01CV8GH.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaactacgccctggcgctatggacgtctggggccaagggaccacggtcaccgtctcctcagcctccaccaagggcccatcggtcttccccctc

SEQ ID NO: 450372 - DNA, 514 bp, Homo sapiens
  misc_feature: HEFZJCU01A0AUL.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggcccatcggtcttccccctggca

SEQ ID NO: 450373 - DNA, 383 bp, Homo sapiens; identical to SEQ ID NO: 444477
  misc_feature: HEFZJCU01DCUQF.47.60.F05.1.454.heavy.3.raw

SEQ ID NO: 450374 - DNA, 518 bp, Homo sapiens
  misc_feature: HEFZJCU01D87YO.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactactttgaattttggggccagggagcctggtcaccgt

SEQ ID NO: 450375 - DNA, 490 bp, Homo sapiens; identical to SEQ ID NO: 446389
  misc_feature: HEFZJCU01EH4BI.3.34.D01.1.454.heavy.3.raw

SEQ ID NO: 450376 - DNA, 490 bp, Homo sapiens
  misc_feature: HEFZJCU01DGBPB.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctcggcgccctgctccaggagcacctccgagagcacagcggccctgggctgcctggtcaaggactacttcccatactcgta

SEQ ID NO: 450377 - DNA, 356 bp, Homo sapiens; identical to SEQ ID NO: 444460
  misc_feature: HEFZJCU01ADWSI.47.38.D05.1.454.heavy.3.raw

SEQ ID NO: 450378 - DNA, 498 bp, Homo sapiens
  misc_feature: HEFZJCU01DW9V0.48.21.B10.1.454.heavy.3.raw
agtatacatacacgaccggtgctcgatttagtgtcgtcgcaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggcccgagcgcagtggcttttgatgccttgatatgtgggccaagggacaatggtcacgtctctc

SEQ ID NO: 450379 - DNA, 491 bp, Homo sapiens
  misc_feature: HEFZJCU01D6OI3.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatatgt

SEQ ID NO: 450380 - DNA, 536 bp, Homo sapiens
  misc_feature: HEFZJCU01B6Y5H.13.64.F09.1.454.heavy.3.raw
tcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccgaataaccagttctccctgaaagtgacctctgtgaccgtcgcagacacggccatttattattgtgtgagatacgtacttttggaatggctatgactcgatcgactactggggccctggaatcctggtcaccgtctcctcagcctccaccaagggcccatcggtcttcccctggccaccct

SEQ ID NO: 450381 - DNA, 516 bp, Homo sapiens; identical to SEQ ID NO: 448668
  misc_feature: HEFZJCU01ESUWV.19.86.H09.1.454.heavy.3.raw

SEQ ID NO: 450382 - DNA, 489 bp, Homo sapiens; identical to SEQ ID NO: 444591
  misc_feature: HEFZJCU01BGPTX.18.70.G04.1.454.heavy.3.raw

SEQ ID NO: 450383 - DNA, 469 bp, Homo sapiens
  misc_feature: HEFZJCU01BQS34.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttccctcagtgct

SEQ ID NO: 450384 - DNA, 531 bp, Homo sapiens
  misc_feature: HEFZJCU01C6K4P.49.78.H01.1.454.heavy.3.raw
  modified_base (503)..(503): a, c, t, g, unknown or other
agtcgagagacacgaccggtgctcgatttagtgtgagtagtttgggtttggggagctctgagacgaggagcccagccctgggattttcaggtgttttcatttggtgatcaggactgaacagagagaactcaccatggagtttgggctgagcgtggcgttttcttaggtggctacttttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatggatggtaacacaaactatgcagactccgtgaagggccggttcaccatctccagagacaattccaagaatatgctatttctgcaaatgaacagcctgagaatcgaggacacggccgtatattactgtgtgaaaagaagatgggaccncgtggacgaggacgccctacggcgggtt

SEQ ID NO: 450385 - DNA, 513 bp, Homo sapiens
  misc_feature: HEFZJCU01DHQOB.12.55.E11.1.454.heavy.3.raw
  modified_base (505)..(505): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttcaccaagggcccatcggtcttcccctggcgccctgctccaggagcacctctgggggcacngcggcccg

SEQ ID NO: 450386 - DNA, 512 bp, Homo sapiens
  misc_feature: HEFZJCU01EU9AN.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttgactactggggccaac

SEQ ID NO: 450387 - DNA, 491 bp, Homo sapiens; identical to SEQ ID NO: 445531
  misc_feature: HEFZJCU01EVLT4.11.38.D05.1.454.heavy.3.raw

SEQ ID NO: 450388 - DNA, 475 bp, Homo sapiens
  misc_feature: HEFZJCU01CXA28.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctcggcgccctgctccaggagcacctccgagagcacagcggccctgggctgcctggtcaaggctacttccgagtgcgtct

SEQ ID NO: 450389 - DNA, 501 bp, Homo sapiens
  misc_feature: HEFZJCU01C40OQ.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaaattttatgcggactccgtgaacggtcgattcaccatctccagagacaattccaggaacacactgtttctgcaaatgaacagcctgagaattgaggactcgggtatatactactgtgcccgtgacccctgactgataaccggactggttcgaccctggggccagggaaccctggtcaccgtctcctccg

SEQ ID NO: 450390 - DNA, 531 bp, Homo sapiens
  misc_feature: HEFZJCU01CP6NR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggg

SEQ ID NO: 450391 - DNA, 516 bp, Homo sapiens
  misc_feature: HEFZJCU01DPNAA.10.83.H06.1.454.heavy.3.raw
catagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtctgggggaggcttggttcagccagggcggtccctgagactctcttgtacagcctctggatttaggtttcgtgattatgctatgagctggttccggcaggctccagggaaggggctggagtgggtaggtttcattagaagcatagcctatggtggggcttcagaatccgccgcgtctgtgaaaggccgattcaccatctcaagagacgatcccaaaagcctcgcctacctgaaatggacagcctgaaaagcgacgacacaggcgtctattattgtgttagagggaccatcgcgatagcagttcctagagggg

SEQ ID NO: 450392 - DNA, 527 bp, Homo sapiens
  misc_feature: HEFZJCU01BYYAB.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaagtaccttcagcactggggccagggcaccctggtcaccgtctcctcagcctccaccaagggcccatcggtcttcccctggccaccctcctccaagagcacctctgggggcacagcc

SEQ ID NO: 450393 - DNA, 492 bp, Homo sapiens
  misc_feature: HEFZJCU01DTXQB.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgcctccaggacgcacctccgagagcacagcggccctggggctgcctggtcaaggactacttcctacgtgagct

SEQ ID NO: 450394 - DNA, 484 bp, Homo sapiens
  misc_feature: HEFZJCU01C0JPQ.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgccctgctccaggagcacctccgagagcacagcggccctgggctgcctggtcaggactacttctacgtgagct

SEQ ID NO: 450395 - DNA, 519 bp, Homo sapiens; identical to SEQ ID NO: 445330
  misc_feature: HEFZJCU01ETCIJ.7.78.H01.1.454.heavy.3.raw

SEQ ID NO: 450396 - DNA, 509 bp, Homo sapiens
  misc_feature: HEFZJCU01BDXH2.11.28.C06.1.454.heavy.3.raw
cgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaaactcactatatctggaaatgactagcctgagactcgaggacacggccgtttattactgtgcgacgcccgccgatagcagcatcatctactggggccagggggaccctggtcaccgtctcctctgcctccaccaaggcccatcggtcttcccctgcgcctgctccagagcacctccgagagcac

SEQ ID NO: 450397 - DNA, 402 bp, Homo sapiens; identical to SEQ ID NO: 444584
  misc_feature: HEFZJCU01EH6U9.10.77.G11.1.454.heavy.3.raw

SEQ ID NO: 450398 - DNA, 427 bp, Homo sapiens; identical to SEQ ID NO: 444708
  misc_feature: HEFZJCU01CHGRW.9.34.D01.1.454.heavy.3.raw

SEQ ID NO: 450399 - DNA, 485 bp, Homo sapiens
  misc_feature: HEFZJCU01B83FM.48.57.F02.1.454.heavy.3.raw
agtatacatacacgaccggtgctcgatttagctcgatatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 450400 - DNA, 477 bp, Homo sapiens; identical to SEQ ID NO: 444659
  misc_feature: HEFZJCU01EDYJ3.16.10.A10.1.454.heavy.3.raw

SEQ ID NO: 450401 - DNA, 494 bp, Homo sapiens
  misc_feature: HEFZJCU01EM9R0.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttaggggaatgaccacgtc

SEQ ID NO: 450402 - DNA, 400 bp, Homo sapiens; identical to SEQ ID NO: 444452
  misc_feature: HEFZJCU01BNNNO.47.24.C02.1.454.heavy.3.raw

SEQ ID NO: 450403 - DNA, 507 bp, Homo sapiens
  misc_feature: HEFZJCU01COQN8.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctggggccaac

SEQ ID NO: 450404 - DNA, 499 bp, Homo sapiens
  misc_feature: HEFZJCU01DYCVZ.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggcctgggctgcctggtcaaggactactcctatgtatact

SEQ ID NO: 450405 - DNA, 505 bp, Homo sapiens
  misc_feature: HEFZJCU01D9MSF.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactcttccgagtagtaca

SEQ ID NO: 450406 - DNA, 509 bp, Homo sapiens
  misc_feature: HEFZJCU01DSXB4.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggcctgggctgcctggtcaaggactacttccgagtagtaca

SEQ ID NO: 450407 - DNA, 509 bp, Homo sapiens
  misc_feature: HEFZJCU01DRGPE.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcc

SEQ ID NO: 450408 - DNA, 492 bp, Homo sapiens; identical to SEQ ID NO: 444827
  misc_feature: HEFZJCU01A0M3P.4.28.C06.1.454.heavy.3.raw

SEQ ID NO: 450409 - DNA, 518 bp, Homo sapiens
  misc_feature: HEFZJCU01B7AQJ.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggtggttcgaccctggggccagggaaccctggtcaccgtctcctcagcct

SEQ ID NO: 450410 - DNA, 514 bp, Homo sapiens
  misc_feature: HEFZJCU01CZ0MM.13.55.E11.1.454.heavy.3.raw
tcacgtactacacgaccggtgctcgatttagcactcgcacgttgggtttgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgttctgcaatgaacagcctgactgccggggacactgccgtgtattactgtgccagcagcagtacctggccactattattttttgtacttctc

SEQ ID NO: 450411 - DNA, 395 bp, Homo sapiens; identical to SEQ ID NO: 444517
  misc_feature: HEFZJCU01BMPGI.16.68.G02.1.454.heavy.3.raw

SEQ ID NO: 450412 - DNA, 309 bp, Homo sapiens
  misc_feature: HEFZJCU01CD36F.49.25.C03.1.454.heavy.3.raw
agtcgagagacacgaccggtgctcgatttagtagtgtagatttgggtttgggatgctatttctgcaaatgaacagcctgagaatcgaggacacggccgtatattactgtgtgaaagaagatggaccgctggacgaggagccctacggcgggtcctactttgactactggggccggggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 450413 - DNA, 526 bp, Homo sapiens; identical to SEQ ID NO: 448857
  misc_feature: HEFZJCU01EDJIX.7.70.G04.1.454.heavy.3.raw

SEQ ID NO: 450414 - DNA, 523 bp, Homo sapiens
  misc_feature: HEFZJCU01BC4IN.12.71.G05.1.454.heavy.3.raw
  modified_base (424)..(424): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccnccaaggcccatccgtcttcccctcggcgccctgctccaggagcacctcccgagagcacacgcggccctgggctgcctggtcaaggactacttcctaccg

SEQ ID NO: 450415 - DNA, 503 bp, Homo sapiens
  misc_feature: HEFZJCU01AFK8H.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 450416 - DNA, 521 bp, Homo sapiens; identical to SEQ ID NO: 445317
  misc_feature: HEFZJCU01AMHTG.12.40.D07.1.454.heavy.3.raw

SEQ ID NO: 450417 - DNA, 400 bp, Homo sapiens; identical to SEQ ID NO: 444452
  misc_feature: HEFZJCU01DX68T.47.24.C02.1.454.heavy.3.raw

SEQ ID NO: 450418 - DNA, 506 bp, Homo sapiens
  misc_feature: HEFZJCU01DF64S.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctgggctgcctggtcaaggactactccgagtagtaca

SEQ ID NO: 450419 - DNA, 477 bp, Homo sapiens; identical to SEQ ID NO: 444659
  misc_feature: HEFZJCU01DS4LP.16.10.A10.1.454.heavy.3.raw

SEQ ID NO: 450420 - DNA, 492 bp, Homo sapiens; identical to SEQ ID NO: 447948
  misc_feature: HEFZJCU01EYO10.10.29.C07.1.454.heavy.3.raw

SEQ ID NO: 450421 - DNA, 427 bp, Homo sapiens; identical to SEQ ID NO: 444708
  misc_feature: HEFZJCU01A9IUS.9.34.D01.1.454.heavy.3.raw

SEQ ID NO: 450422 - DNA, 537 bp, Homo sapiens
  misc_feature: HEFZJCU01CTODW.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccatcggtcttcccctggcaccctcctccaagagcacctctggggggcacagcggccctgggctgcctgggt

SEQ ID NO: 450423 - DNA, 317 bp, Homo sapiens
  misc_feature: HEFZJCU01C3284.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctcccaagagcacctctgggggcacagcggccctgggctgcctggtcaaggactacttcctacgtgagct

SEQ ID NO: 450424 - DNA, 490 bp, Homo sapiens
  misc_feature: HEFZJCU01EEFRK.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgacgagcacagcggccctgggctgcctggttcaggactacttcccatactcgta

SEQ ID NO: 450425 - DNA, 526 bp, Homo sapiens
  misc_feature: HEFZJCU01AVTKV.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgcctgctccaggagcacctccgagagcacagcggccctgggctgcctggtcaaggactacttccacg

SEQ ID NO: 450426 - DNA, 463 bp, Homo sapiens; identical to SEQ ID NO: 446208
  misc_feature: HEFZJCU01D4D2G.19.10.A10.1.454.heavy.3.raw

SEQ ID NO: 450427 - DNA, 514 bp, Homo sapiens
  misc_feature: HEFZJCU01D1RJ0.53.70.G04.1.454.heavy.3.raw
cgcgtatacacacgaccggtgctcgatttagtgtagtgtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttccccctggcgccctgctccaggagcacctccgagagcacagccggcctgggctgcctggtcaaggacctacttcc

SEQ ID NO: 450428 - DNA, 529 bp, Homo sapiens
  misc_feature: HEFZJCU01EO1EK.49.34.D01.1.454.heavy.3.raw
agtcgagagacacgaccggtgctcgatttagatcgtctgtgttgggtttgggctgagcgtgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttcccctggcaccctcctccaagagcacctctc

SEQ ID NO: 450429 - DNA, 509 bp, Homo sapiens
  misc_feature: HEFZJCU01BHNV8.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaacgagcacctctgggggcacagcggccctgggctgcctggtcaggactacttcctacgtcgtat

SEQ ID NO: 450430 - DNA, 506 bp, Homo sapiens
  misc_feature: HEFZJCU01DIFOS.48.18.B07.1.454.heavy.3.raw
agtatacatacacgaccggtgctcgatttagtcgctgcgtaagggggagagaggagccttagccctggattccaaggcctatccacttggtgaccagcactgagcaccgagggttcaccatggaattggggctccgctgggttttcctggttgctgttttagcaggtggcagtgtgacgtgcacctgctggagtcggggggaggcctggtcaagcggggggggtccctgagactctcttgtgaagcctctaaatcagtctcgagagttccagcatgaactgggtccgccaggctccagggaagggcctggagtgggtctcatccatcagcagtggaggcaaccatatgttgtatgccgactcagtgaggggccgattcagcgtctccagagacaacgccaagatgcagtatatctaggaatgaacaacctaagagtcgaggacacggctgtctactctgtgcgagagatgtgattccagtgactgggtgggtggttactttgacta

SEQ ID NO: 450431 - DNA, 515 bp, Homo sapiens
  misc_feature: HEFZJCU01BKWQ2.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcacccgggatactactccaccttcggcttggacatctggggccgac

SEQ ID NO: 450432 - DNA, 497 bp, Homo sapiens
  misc_feature: HEFZJCU01BEOOZ.40.34.D01.1.454.heavy.3.raw
tctagcgactcacgaccggtgctcgatttagatcgtctgtgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 450433 - DNA, 494 bp, Homo sapiens
  misc_feature: HEFZJCU01ESPPM.16.37.D04.1.454.heavy.3.raw
tgtactactccacgaccggtgctcgatttagtagcatactgtgggtttgggggagacttagtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaggactacttccgagtagtaca

SEQ ID NO: 450434 - DNA, 482 bp, Homo sapiens; identical to SEQ ID NO: 444503
  misc_feature: HEFZJCU01BFJ4S.7.10.A10.1.454.heavy.3.raw

SEQ ID NO: 450435 - DNA, 518 bp, Homo sapiens
  misc_feature: HEFZJCU01EGOL9.13.76.G10.1.454.heavy.3.raw
tcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 450436 - DNA, 528 bp, Homo sapiens
  misc_feature: HEFZJCU01CS5KS.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaaagaacactctatttcttcaaatggacagcctgaaagacgaaagacaacgggcgtgtattttgtgtgaaagataacgaagtctaatgatacccaaatttgggaaggggcctttcgat

SEQ ID NO: 450437 - DNA, 529 bp, Homo sapiens
  misc_feature: HEFZJCU01DUOLK.48.37.D04.1.454.heavy.3.raw
agtatacatacacgaccggtgctcgatttagtagcatactgttgggtttgggtgccgaagttgctggaggcttggtccagcctggggggtccctgaaactctcctgtacagcctctgggttcgccttcacagcctctgggttcagcttcagtgcctctgctatgcactgggtccgccaggcttccgggagagggcttgagtgggttgccgtattagaacaaaacctaataattacgcgacagcatttgctgcgtcggtgagaggcaggttcaccctcctcagagacgattccaagaacacggcgtatctgcaaatggacaacctgaaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctcgggctgcctggtcaaggactacttcctatgtatact

SEQ ID NO: 450438 - DNA, 490 bp, Homo sapiens
  misc_feature: HEFZJCU01EHIM5.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctcccgagagcacagcggccctgggctgcctggtcaaggactacttcctacgtgagct

SEQ ID NO: 450439 - DNA, 518 bp, Homo sapiens; identical to SEQ ID NO: 444718
  misc_feature: HEFZJCU01EUZL1.9.34.D01.1.454.heavy.3.raw

SEQ ID NO: 450440 - DNA, 523 bp, Homo sapiens
  misc_feature: HEFZJCU01D8MLC.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaatactataacactgctccttttacacctccttgacttctgggccatgaacccggtcc

SEQ ID NO: 450441 - DNA, 514 bp, Homo sapiens
  misc_feature: HEFZJCU01EXG1E.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggacctgaacagcctaagtcctgaggacacgggtgtatactactgtacgaagggaggggggaaccgaggcgggagttccaagtactcctttg

SEQ ID NO: 450442 - DNA, 481 bp, Homo sapiens
  misc_feature: HEFZJCU01DN5PG.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggccaccctcctccaagagcacctctgggggcacagcggccctggctgcctggtcaaggactattcctagagacacg

SEQ ID NO: 450443 - DNA, 508 bp, Homo sapiens; identical to SEQ ID NO: 446002
  misc_feature: HEFZJCU01EO222.9.78.H01.1.454.heavy.3.raw

SEQ ID NO: 450444 - DNA, 501 bp, Homo sapiens
  misc_feature: HEFZJCU01CW5Y3.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgataggaaatcagggatgggggccagggaaccctggtcaccgtctcctcagcctccaccaagggcccatcggtcttcccctggcgccctgctccaggagcacctccgagagcacagcggccctgggctgcctggtcaaggactacttccga

SEQ ID NO: 450445 - DNA, 506 bp, Homo sapiens; identical to SEQ ID NO: 444696
  misc_feature: HEFZJCU01CCW7T.16.34.D01.1.454.heavy.3.raw

SEQ ID NO: 450446 - DNA, 530 bp, Homo sapiens
  misc_feature: HEFZJCU01BPUYD.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgttttattactgtgcgagaggggacggactacgggtgactactgggggttcgacccctggggccaggggaaccctggtcaccgtctcctcagcctccaccg

SEQ ID NO: 450447 - DNA, 497 bp, Homo sapiens; identical to SEQ ID NO: 444995
  misc_feature: HEFZJCU01A1R58.4.26.C04.1.454.heavy.3.raw

SEQ ID NO: 450448 - DNA, 485 bp, Homo sapiens
  misc_feature: HEFZJCU01EA461.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctgcgcctgctcaggagcacctccgagagcacagcggccctgggctgcctggtcaaggactacttcccatactcgta

SEQ ID NO: 450449 - DNA, 503 bp, Homo sapiens
  misc_feature: HEFZJCU01DM9KV.48.53.E09.1.454.heavy.3.raw
  modified_base (477)..(477): a, c, t, g, unknown or other
agtatacatacacgaccggtgctcgatttagagagagtgtgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttatactgggcctggatccgccagcccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcngtggttcgacccctggggccagggat

SEQ ID NO: 450450 - DNA, 526 bp, Homo sapiens
  misc_feature: HEFZJCU01BWLSQ.49.33.C11.1.454.heavy.3.raw
agtcgagagacacgaccggtgctcgatttagagtgagctcgttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttccccctggcgccctgctccaggagcacctccgagagcacagcc

SEQ ID NO: 450451 - DNA, 515 bp, Homo sapiens
  misc_feature: HEFZJCU01AIP23.4.36.D03.1.454.heavy.3.raw
agcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagcaacaaggaaaacccagctcagccccaattccatggtgagtcctctgtgctcagtgctgatcaccaagtggaaaggccttggagtccagggctaaggctcctctctgagacctccaccaagggcccatcggtcttccccctggcgccctgctccaggagcacctccgagagcacagcggccctgggctgcctggtcaaggactacttccctactacg

SEQ ID NO: 450452 - DNA, 313 bp, Homo sapiens
  misc_feature: HEFZJCU01C79E0.48.11.A11.1.454.heavy.3.raw
agtatacatacacgaccggtgctcgatttagctacgactgcagggacaacgccaagagttcactgtttctgcaaatgagcagcctgagagccgaggacacggctctatattactgtacgagagatttcagcccctcccaaagtggaaattattatgatgcatttgatatttggggccaggggacagtggtcacagtctcttcagcctccaccaagggcccatcggtcttccccctggcgccctgctccaggagcacctccgagagcacagcggccctgggctgcctggtcaaggactacttcctatgtatact

SEQ ID NO: 450453 - DNA, 313 bp, Homo sapiens
  misc_feature: HEFZJCU01DW76B.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 450454 - DNA, 396 bp, Homo sapiens; identical to SEQ ID NO: 444469
  misc_feature: HEFZJCU01DW4KM.47.46.E02.1.454.heavy.3.raw

SEQ ID NO: 450455 - DNA, 510 bp, Homo sapiens; identical to SEQ ID NO: 445542
  misc_feature: HEFZJCU01B7AOX.16.21.B10.1.454.heavy.3.raw

SEQ ID NO: 450456 - DNA, 508 bp, Homo sapiens
  misc_feature: HEFZJCU01C6GQV.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctcgtcgtat

SEQ ID NO: 450457 - DNA, 402 bp, Homo sapiens; identical to SEQ ID NO: 444846
  misc_feature: HEFZJCU01AFRNM.14.60.F05.1.454.heavy.3.raw

SEQ ID NO: 450458 - DNA, 498 bp, Homo sapiens; identical to SEQ ID NO: 445952
  misc_feature: HEFZJCU01C8AQR.11.71.G05.1.454.heavy.3.raw

SEQ ID NO: 450459 - DNA, 496 bp, Homo sapiens
  misc_feature: HEFZJCU01BFAI0.51.83.H06.1.454.heavy.3.raw
cgatcgtatacacgaccggtgctcgatttagatcacgtgcgtcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaaagaattgggtttcagtgg

SEQ ID NO: 450460 - DNA, 486 bp, Homo sapiens
  misc_feature: HEFZJCU01B5MIC.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctgggtcagcgtctcctcagcctccaccaagggcccatcggtcttcccctggcgccctgctccaggagcacctccgagagcacagcggccctgggctgcctggtcaggactacttcctacgtgagct

SEQ ID NO: 450461 - DNA, 510 bp, Homo sapiens
  misc_feature: HEFZJCU01EA2P8.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttccccctggccgccctgctccaggagcacctccgagagcacagcggccctgggctgcctggtcaaggactacttccgagtgcgtct

SEQ ID NO: 450462 - DNA, 477 bp, Homo sapiens
  misc_feature: HEFZJCU01B8MOS.4.43.D10.1.454.heavy.3.raw
agcactgtagcacgaccggtgctcgatttagactagcagtaagggggctctgggagaagagccccagccccagacttcccaggagattccattcggtgatcagcactgaacacagaggactcaccatggagtttgggctgagctgggttttccttgctgctattataaaaggtgtcctgtgtcaggtgcacctggtggagtctgggggagccttggtcaagcctggagggtccctgagactctcctgtgcgacctctggattcaccttcagtgactaccagatgagctgggtccgccaggctccagggagggggctggagtggctttcatacatcactagtcgtactgagagtgcacactacgcagtctctgtgaggggccgattcaccatctccagggacaacgccaagcactcactgtatctgcagatgaacagcctgagagccgaggacacggccgtctattactgtgcgagag

SEQ ID NO: 450463 - DNA, 501 bp, Homo sapiens; identical to SEQ ID NO: 445027
  misc_feature: HEFZJCU01EVI32.26.23.C01.1.454.heavy.3.raw

SEQ ID NO: 450464 - DNA, 492 bp, Homo sapiens; identical to SEQ ID NO: 444827
  misc_feature: HEFZJCU01B8KLY.4.28.C06.1.454.heavy.3.raw

SEQ ID NO: 450465 - DNA, 542 bp, Homo sapiens
  misc_feature: HEFZJCU01BU7GA.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttagggggagttatcgcgaaacgggggggtacgtacgtacgt

SEQ ID NO: 450466 - DNA, 477 bp, Homo sapiens; identical to SEQ ID NO: 444659
  misc_feature: HEFZJCU01CJCR4.16.10.A10.1.454.heavy.3.raw

SEQ ID NO: 450467 - DNA, 392 bp, Homo sapiens; identical to SEQ ID NO: 444682
  misc_feature: HEFZJCU01EBQ24.16.70.G04.1.454.heavy.3.raw

SEQ ID NO: 450468 - DNA, 524 bp, Homo sapiens
  misc_feature: HEFZJCU01AMH8N.12.40.D07.1.454.heavy.3.raw
  modified_base (487)..(487): a, c, t, g, unknown or other
atacgacgtacacgaccggtgctcgatttagtgatagagcgtaacaacagagggctcaccatggagtttgggctgagcgtggtttcgtcgtaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccngcctccaccaagggcccatccggtcttccccctggcg

SEQ ID NO: 450469 - DNA, 397 bp, Homo sapiens
  misc_feature: HEFZJCU01AVHZA.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 450470 - DNA, 387 bp, Homo sapiens; identical to SEQ ID NO: 444818
  misc_feature: HEFZJCU01A4G0B.11.79.H02.1.454.heavy.3.raw

SEQ ID NO: 450471 - DNA, 524 bp, Homo sapiens; identical to SEQ ID NO: 445902
  misc_feature: HEFZJCU01DGV5Z.9.78.H01.1.454.heavy.3.raw

SEQ ID NO: 450472 - DNA, 403 bp, Homo sapiens; identical to SEQ ID NO: 444658
  misc_feature: HEFZJCU01DFLWY.14.60.F05.1.454.heavy.3.raw

SEQ ID NO: 450473 - DNA, 501 bp, Homo sapiens; identical to SEQ ID NO: 445027
  misc_feature: HEFZJCU01DDC2G.26.23.C01.1.454.heavy.3.raw

SEQ ID NO: 450474 - DNA, 512 bp, Homo sapiens; identical to SEQ ID NO: 449621
  misc_feature: HEFZJCU01B0G53.13.21.B10.1.454.heavy.3.raw

SEQ ID NO: 450475 - DNA, 500 bp, Homo sapiens; identical to SEQ ID NO: 445720
  misc_feature: HEFZJCU01C3M02.3.20.B09.1.454.heavy.3.raw

SEQ ID NO: 450476 - DNA, 524 bp, Homo sapiens
  misc_feature: HEFZJCU01EP3V3.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactactcc

SEQ ID NO: 450477 - DNA, 519 bp, Homo sapiens; identical to SEQ ID NO: 449382
  misc_feature: HEFZJCU01B1CVS.16.10.A10.1.454.heavy.3.raw

SEQ ID NO: 450478 - DNA, 509 bp, Homo sapiens
  misc_feature: HEFZJCU01DYVUI.19.13.B02.1.454.heavy.3.raw
tactctcgtgcacgaccggtgctcgatttagtctagcgactttgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagttggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggcgccctgctccaggagcacctccgagagcaca

SEQ ID NO: 450479 - DNA, 520 bp, Homo sapiens; identical to SEQ ID NO: 447034
  misc_feature: HEFZJCU01CFJ89.16.10.A10.1.454.heavy.3.raw

SEQ ID NO: 450480 - DNA, 511 bp, Homo sapiens; identical to SEQ ID NO: 445840
  misc_feature: HEFZJCU01CMUYN.11.13.B02.1.454.heavy.3.raw

SEQ ID NO: 450481 - DNA, 381 bp, Homo sapiens
  misc_feature: HEFZJCU01EP0C6.53.27.C05.1.454.heavy.3.raw
cgcgtatacacacgaccggtgctcgatttagacgcgatcgaagggtgggggtcttgatcctgaaaatggtggaagagtctacgcgcagaagtttcagggcagagtcaccgtgacccaggacacatctagagacacagcctacatggaactcagaagcctgaggtctgaagacacggccgtctattattgtacaacccttgttgttcgggaggattgggctgacaattggttcgacccctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 450482 - DNA, 501 bp, Homo sapiens
  misc_feature: HEFZJCU01DB11B.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggctttttgattgcctttgatatgtgggcagggacaatggtcaccgt

SEQ ID NO: 450483 - DNA, 511 bp, Homo sapiens
  misc_feature: HEFZJCU01EK0HE.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattgggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggagggggaacagcggagtccaagtactc

SEQ ID NO: 450484 - DNA, 478 bp, Homo sapiens
  misc_feature: HEFZJCU01DDVOH.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggccatcggtcttcccctggcgccctgctccaggagcacctccgagagcacagcgccctgggctgcctggtcaaggactacttccacgcgtatgt

SEQ ID NO: 450485 - DNA, 499 bp, Homo sapiens
  misc_feature: HEFZJCU01DT8MD.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacagaaaagcggtggcctagtc

SEQ ID NO: 450486 - DNA, 519 bp, Homo sapiens
  misc_feature: HEFZJCU01DGC4E.49.67.G01.1.454.heavy.3.raw
agtcgagagacacgaccggtgctcgatttagagtatacatattgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctctctcgact

SEQ ID NO: 450487 - DNA, 508 bp, Homo sapiens
  misc_feature: HEFZJCU01A1IW9.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggc

SEQ ID NO: 450488 - DNA, 486 bp, Homo sapiens; identical to SEQ ID NO: 446117
  misc_feature: HEFZJCU01CUOR0.51.14.B03.1.454.heavy.3.raw

SEQ ID NO: 450489 - DNA, 478 bp, Homo sapiens
  misc_feature: HEFZJCU01DD2DH.48.83.H06.1.454.heavy.3.raw
agtatacatacacgaccggtgctcgatttagatcacgtgcgtcgcgggcacgaccggtgctcgatttagtcgagctctctcgcgggcacgaccggtgctcgatttagcacatacgcagggaaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaacctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 450490 - DNA, 519 bp, Homo sapiens; identical to SEQ ID NO: 448423
  misc_feature: HEFZJCU01AQ52A.16.86.H09.1.454.heavy.3.raw

SEQ ID NO: 450491 - DNA, 489 bp, Homo sapiens
  misc_feature: HEFZJCU01EVA5J.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattgctgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaaggactactcccatactcgta

SEQ ID NO: 450492 - DNA, 399 bp, Homo sapiens
  misc_feature: HEFZJCU01B03EM.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtggtattactgtgcgaaggcctttgccccaaacgtggatatagtggctaactttgactactggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 450493 - DNA, 475 bp, Homo sapiens; identical to SEQ ID NO: 445138
  misc_feature: HEFZJCU01BVI8P.3.39.D06.1.454.heavy.3.raw

SEQ ID NO: 450494 - DNA, 503 bp, Homo sapiens
  misc_feature: HEFZJCU01EHTKL.48.18.B07.1.454.heavy.3.raw
agtatacatacacgaccggtgctcgatttagtcgctgcgtaagggggagagaggagccttagccctggattccaaggcctatccacttggtgaccagcactgagcaccgagggttcaccatggaattggggctccgctgggttttcctggttgctgttttagcaggtggccagtgtgacgtgcacctgctggagtcggggggaggcctggtcaagcgggggggtccctgagactctcttgtgaagcctctaaaatcagtctcgagagttccagcatgaactgggtccgccaggctccagggaagggcctggagtgggtctcatccatcagcagtggaggcaaccatatgttgtatgccgactcagtgagggccgattcagcgtctccagagacaacgccaagatgtcagtatatctggaaatgaacaacctaagagtcgaggacacggctgtctactactgtgcgagagatgtgattccagtgactggtgggtggtactttga

SEQ ID NO: 450495 - DNA, 501 bp, Homo sapiens
  misc_feature: HEFZJCU01CN9PE.48.73.G07.1.454.heavy.3.raw
agtatacatacacgaccggtgctcgatttagctctacgctcaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattactccctgaagctgagctctgtgaccgccgcagacacggctgtctattactgtgcgaggccccgagcgcagtggctttttgatgcctttgatatgtggggccgaagggacaatggtctaccg

SEQ ID NO: 450496 - DNA, 509 bp, Homo sapiens; identical to SEQ ID NO: 445824
  misc_feature: HEFZJCU01B56AH.9.14.B03.1.454.heavy.3.raw

SEQ ID NO: 450497 - DNA, 488 bp, Homo sapiens
  misc_feature: HEFZJCU01CP6T9.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgctggtcaaggactacttcctacgtgagct

SEQ ID NO: 450498 - DNA, 507 bp, Homo sapiens
  misc_feature: HEFZJCU01DQ2BZ.5.31.C09.1.454.heavy.3.raw
atcagacacgcacgaccggtgctcgatttagacgtctcatcaaggaaggaagggggctctgggagaggagccccagccctgagattcccaggtgtttccattcggtgatcagcactgaacacagagaacgcaccatggagtttggactgacctgggttctccttgttgctattttaaaaggtgtccagtgtgcagtgcagctggtgcagtcggggggagtcgtggtgcagcctgggggtccctgacactctcctgtgaagcctctggattcacgttcgatgattataccatgcactgggtccgtcaagttccgggaccggtctagagtgggtcgcttttatcagttgggatggtggcgccacagcctatgcagactctttgaagggccgattcaccatctccagagacaacaccaataactccctctttctgcaaatgacgagtctgaagactgacgacactggcttgtattactgtgtcaaagagggtggcgcgataggagccttt

SEQ ID NO: 450499 - DNA, 449 bp, Homo sapiens
  misc_feature: HEFZJCU01EKEGR.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 450500 - DNA, 512 bp, Homo sapiens
  misc_feature: HEFZJCU01C7FDS.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccg

SEQ ID NO: 450501 - DNA, 518 bp, Homo sapiens
  misc_feature: HEFZJCU01CWOER.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctgggtcaccgtcaaacc

SEQ ID NO: 450502 - DNA, 396 bp, Homo sapiens; identical to SEQ ID NO: 444469
  misc_feature: HEFZJCU01C3KQP.47.46.E02.1.454.heavy.3.raw

SEQ ID NO: 450503 - DNA, 339 bp, Homo sapiens; identical to SEQ ID NO: 444436
  misc_feature: HEFZJCU01CLBGC.47.38.D05.1.454.heavy.3.raw

SEQ ID NO: 450504 - DNA, 526 bp, Homo sapiens
  misc_feature: HEFZJCU01AROG6.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatggacccggtacg

SEQ ID NO: 450505 - DNA, 494 bp, Homo sapiens
  misc_feature: HEFZJCU01D2UGR.40.82.H05.1.454.heavy.3.raw
tctagcgactcacgaccggtgctcgatttagtcgagctctctcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactc

SEQ ID NO: 450506 - DNA, 531 bp, Homo sapiens
  misc_feature: HEFZJCU01CV3FH.49.33.C11.1.454.heavy.3.raw
agtcgagagacacgaccggtgctcgatttagagtgagctcgttgggtttgggctgagctgggttttccttgttgctaattttaaaaggtgtccagtgtgacgtgcaggtggtggagtcgtggggggaggcttggtccagccgtggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttccccctggcgccctgcctccaggagcacctccgagagcacagcc

SEQ ID NO: 450507 - DNA, 539 bp, Homo sapiens
  misc_feature: HEFZJCU01EJ13K.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcgggccggtaccgtccggagttggttttggtatttcgtggggtccgaaggggaacg

SEQ ID NO: 450508 - DNA, 396 bp, Homo sapiens; identical to SEQ ID NO: 444469
  misc_feature: HEFZJCU01ACVWY.47.46.E02.1.454.heavy.3.raw

SEQ ID NO: 450509 - DNA, 518 bp, Homo sapiens; identical to SEQ ID NO: 444718
  misc_feature: HEFZJCU01CJ19N.9.34.D01.1.454.heavy.3.raw

SEQ ID NO: 450510 - DNA, 506 bp, Homo sapiens; identical to SEQ ID NO: 446520
  misc_feature: HEFZJCU01CP0GV.10.38.D05.1.454.heavy.3.raw

SEQ ID NO: 450511 - DNA, 316 bp, Homo sapiens; identical to SEQ ID NO: 444444
  misc_feature: HEFZJCU01BIXA1.47.56.F01.1.454.heavy.3.raw

SEQ ID NO: 450512 - DNA, 492 bp, Homo sapiens; identical to SEQ ID NO: 445919
  misc_feature: HEFZJCU01A7OMR.14.25.C03.1.454.heavy.3.raw

SEQ ID NO: 450513 - DNA, 474 bp, Homo sapiens
  misc_feature: HEFZJCU01EQGBH.12.81.H04.1.454.heavy.3.raw
atacgacgtacacgaccggtgctcgatttagtagtgtagattcgcggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttcccctggcgccctgctccagagcacctccgagagcacagcggccctgggctgcctggtcaaggactacttcctacgtcgtat

SEQ ID NO: 450514 - DNA, 502 bp, Homo sapiens
  misc_feature: HEFZJCU01A47VA.22.69.G03.1.454.heavy.3.raw
acatacgcgtcacgaccggtgctcgatttagtcgctgcgtaaaggagaaagggggagacttggtacagcctggggggtccctgagactctcctgtgtaacctctggattcacctttaggagctatgccatgatgtgggtccgccaggctccagggaaggggctggagtgggtgtcaacgattagtggaagtggtactggtatatactacgcagactccgtgaagggccggttcaccctctccagagacaattccaagaatacggtgtatctgcaaatgaacagcctgagagccgaggacacggccgtatattactgtgcgaatcaaaagttcggggacgtccgattcgatatggacgtctggggccaagggaccacggtcaccgtctcctcagcctccaccaagggcccatcggtcttccccctggcgccctgctccaggagcacctccgagagcacagcggccctgggctgcctggtcaaggactacttccagacgtatca

SEQ ID NO: 450515 - DNA, 513 bp, Homo sapiens
  misc_feature: HEFZJCU01CO178.48.33.C11.1.454.heavy.3.raw
agtatacatacacgaccggtgctcgatttagagtgagctcgttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagtaagggttttactagttgggttcggggagtctccgacccagcaactggttaccg

SEQ ID NO: 450516 - DNA, 463 bp, Homo sapiens; identical to SEQ ID NO: 445513
  misc_feature: HEFZJCU01BSG2J.2.28.C06.1.454.heavy.3.raw

SEQ ID NO: 450517 - DNA, 473 bp, Homo sapiens
  misc_feature: HEFZJCU01DYG6Y.16.10.A10.1.454.heavy.3.raw
  modified_base (251)..(251): a, c, t, g, unknown or other
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacngcctgagagtcgaggacacggccatatattactgtgcgaaagatcctgaggcctataccacctcagtcagctgttcgaccctgggccagggaaccctggtcaccgtctcctcagcctccaccaagggcccatcggtcttccccctggcaccctcctccaagagcacctctggggcacagcggccctgggctgcctggtcaaggactacttccgagtagtaca

SEQ ID NO: 450518 - DNA, 505 bp, Homo sapiens
  misc_feature: HEFZJCU01DF9SI.48.44.D11.1.454.heavy.3.raw
agtatacatacacgaccggtgctcgatttagcgcagtacgaggggaggcttggtccagcctggggggtccctgaaactctcctgtacagcccctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccagggcccatcggtcttcccctggcgccctgctccaggagcacctccgagagcacagcggccctgggctgcctggtcaaggactacttcctatgtatact

SEQ ID NO: 450519 - DNA, 395 bp, Homo sapiens; identical to SEQ ID NO: 444517
  misc_feature: HEFZJCU01B4HHK.16.68.G02.1.454.heavy.3.raw

SEQ ID NO: 450520 - DNA, 504 bp, Homo sapiens
  misc_feature: HEFZJCU01ANAWG.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagtcttttgatctctgggccaagggacactggtcaccgtctcttcagcctccaccaaggcccatcgtcttcccctgccgcctgctccaggacg

SEQ ID NO: 450521 - DNA, 472 bp, Homo sapiens; identical to SEQ ID NO: 447846
  misc_feature: HEFZJCU01EL16Q.22.56.F01.1.454.heavy.3.raw

SEQ ID NO: 450522 - DNA, 502 bp, Homo sapiens
  misc_feature: HEFZJCU01CR0OI.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaaggcccatcggtcttcccctggcgccctgctccaggagcacctccgagagcacagcggccctggctgcctggtcaaggactacttcccactactatg

SEQ ID NO: 450523 - DNA, 520 bp, Homo sapiens
  misc_feature: HEFZJCU01D0SC1.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacccgtggtcgccgtctcctcagcctccaccaagggcccatcggtcttccccctggcaccctcctccaagagcacctctgggggcacagcggccctgggctgcctggtcaaggactacttccagacgtatca

SEQ ID NO: 450524 - DNA, 535 bp, Homo sapiens
  misc_feature: HEFZJCU01C9R98.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcag

SEQ ID NO: 450525 - DNA, 491 bp, Homo sapiens
  misc_feature: HEFZJCU01E0GMG.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaaggcccatcggtcttcccctggcgccctgctccaggagcacctccgagagcacagcggccctgggctgcctggtcaaggactacttccctacagtgct

SEQ ID NO: 450526 - DNA, 517 bp, Homo sapiens
  misc_feature: HEFZJCU01ENMPX.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccaagtactcctttgacgtctggggccac

SEQ ID NO: 450527 - DNA, 521 bp, Homo sapiens
  misc_feature: HEFZJCU01A5JQG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 450528 - DNA, 488 bp, Homo sapiens; identical to SEQ ID NO: 449258
  misc_feature: HEFZJCU01CK5PL.12.53.E09.1.454.heavy.3.raw

SEQ ID NO: 450529 - DNA, 486 bp, Homo sapiens; identical to SEQ ID NO: 448316
  misc_feature: HEFZJCU01CVJ6Z.3.48.E04.1.454.heavy.3.raw

SEQ ID NO: 450530 - DNA, 423 bp, Homo sapiens; identical to SEQ ID NO: 444467
  misc_feature: HEFZJCU01EMYAF.51.41.D08.1.454.heavy.3.raw

SEQ ID NO: 450531 - DNA, 492 bp, Homo sapiens; identical to SEQ ID NO: 444695
  misc_feature: HEFZJCU01B0TZF.3.34.D01.1.454.heavy.3.raw

SEQ ID NO: 450532 - DNA, 490 bp, Homo sapiens; identical to SEQ ID NO: 446494
  misc_feature: HEFZJCU01ERU1Z.11.13.B02.1.454.heavy.3.raw

SEQ ID NO: 450533 - DNA, 494 bp, Homo sapiens
  misc_feature: HEFZJCU01C9727.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 450534 - DNA, 508 bp, Homo sapiens
  misc_feature: HEFZJCU01C734M.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcggcctccaccaagggcccatcggtcttcccctggcgccctgctccaggagcacctccgagagcacagcggccctgggctgcctggtcaaggactacttccagacgtatca

SEQ ID NO: 450535 - DNA, 525 bp, Homo sapiens
  misc_feature: HEFZJCU01AITWM.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaacctggtcaccgtctccccacctccaccg

SEQ ID NO: 450536 - DNA, 504 bp, Homo sapiens
  misc_feature: HEFZJCU01AIM5A.51.53.E09.1.454.heavy.3.raw
cgatcgtatacacgaccggtgctcgatttagagagagtgtgttgggtttggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcacggaggacaacggtgacccccgtccgctcggtgcggaggtctggggccaagggaccgacggtcatcgtctcctcagcctccaccaagggcccatcggtcttcccctggcaccctcctccaagagcacctctgggggcacagcggccctgggctgcctggtcaaggactacttcctcgt

SEQ ID NO: 450537 - DNA, 477 bp, Homo sapiens; identical to SEQ ID NO: 444659
  misc_feature: HEFZJCU01ATWA3.16.10.A10.1.454.heavy.3.raw

SEQ ID NO: 450538 - DNA, 510 bp, Homo sapiens
  misc_feature: HEFZJCU01CMNOP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccaccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 450539 - DNA, 483 bp, Homo sapiens; identical to SEQ ID NO: 444639
  misc_feature: HEFZJCU01CIACZ.11.23.C01.1.454.heavy.3.raw

SEQ ID NO: 450540 - DNA, 384 bp, Homo sapiens; identical to SEQ ID NO: 444454
  misc_feature: HEFZJCU01D3S16.11.61.F06.1.454.heavy.3.raw

SEQ ID NO: 450541 - DNA, 507 bp, Homo sapiens
  misc_feature: HEFZJCU01AOLXN.53.33.C11.1.454.heavy.3.raw
cgcgtatacacacgaccggtgctcgatttagagtgagctcgttgggtttggggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaaccctggtcaccgtctcctcagcttccaccaagggcccatcggtcttcccctggcgccctgctccaggagcacctctcgggggcacagcggcccgtgggctgcctggtcaaggactactcctcgtact

SEQ ID NO: 450542 - DNA, 396 bp, Homo sapiens; identical to SEQ ID NO: 444426
  misc_feature: HEFZJCU01BLT7X.18.31.C09.1.454.heavy.3.raw

SEQ ID NO: 450543 - DNA, 329 bp, Homo sapiens
  misc_feature: HEFZJCU01AQ1TR.48.29.C07.1.454.heavy.3.raw
agtatacatacacgaccggtgctcgatttagagtgctacgaagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 450544 - DNA, 464 bp, Homo sapiens; identical to SEQ ID NO: 445553
  misc_feature: HEFZJCU01BGLOH.19.10.A10.1.454.heavy.3.raw

SEQ ID NO: 450545 - DNA, 501 bp, Homo sapiens; identical to SEQ ID NO: 447965
  misc_feature: HEFZJCU01C90DI.17.10.A10.1.454.heavy.3.raw

SEQ ID NO: 450546 - DNA, 524 bp, Homo sapiens; identical to SEQ ID NO: 445902
  misc_feature: HEFZJCU01DJC1B.9.78.H01.1.454.heavy.3.raw

SEQ ID NO: 450547 - DNA, 498 bp, Homo sapiens; identical to SEQ ID NO: 449824
  misc_feature: HEFZJCU01EYMGX.47.38.D05.1.454.heavy.3.raw

SEQ ID NO: 450548 - DNA, 501 bp, Homo sapiens; identical to SEQ ID NO: 447719
  misc_feature: HEFZJCU01CIZKA.17.10.A10.1.454.heavy.3.raw

SEQ ID NO: 450549 - DNA, 513 bp, Homo sapiens
  misc_feature: HEFZJCU01DLMD7.11.28.C06.1.454.heavy.3.raw
cgagagataccacgaccggtgctcgatttagagctcacgtattgggtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaaactcactatatctggaaatgactagcctgagactcgaggacacggccgtttattactgtgcgacgcccgccgatagcagcatcatctactggggccagggggaccctggtcaccgtctcctctgcctccaccaagggcccatcggtcttcccctggcgccctgctccaggagcacctccgagagcac

SEQ ID NO: 450550 - DNA, 375 bp, Homo sapiens; identical to SEQ ID NO: 444459
  misc_feature: HEFZJCU01B4C9F.48.59.F04.1.454.heavy.3.raw

SEQ ID NO: 450551 - DNA, 407 bp, Homo sapiens; identical to SEQ ID NO: 445632
  misc_feature: HEFZJCU01CJJIW.11.67.G01.1.454.heavy.3.raw

SEQ ID NO: 450552 - DNA, 506 bp, Homo sapiens; identical to SEQ ID NO: 449588
  misc_feature: HEFZJCU01A9I55.11.72.G06.1.454.heavy.3.raw

SEQ ID NO: 450553 - DNA, 508 bp, Homo sapiens
  misc_feature: HEFZJCU01DRT77.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccagagcacctctgggggcacagcggccctgggctgcctggtcaaggactacttcctacgtcgtat

SEQ ID NO: 450554 - DNA, 523 bp, Homo sapiens
  misc_feature: HEFZJCU01CA83V.1.25.C03.1.454.heavy.3.raw
acgagtgcgtcacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 450555 - DNA, 413 bp, Homo sapiens; identical to SEQ ID NO: 444933
  misc_feature: HEFZJCU01D6B4Y.51.60.F05.1.454.heavy.3.raw

SEQ ID NO: 450556 - DNA, 501 bp, Homo sapiens; identical to SEQ ID NO: 447123
  misc_feature: HEFZJCU01A0J8C.3.20.B09.1.454.heavy.3.raw

SEQ ID NO: 450557 - DNA, 511 bp, Homo sapiens
  misc_feature: HEFZJCU01AR1FW.13.65.F10.1.454.heavy.3.raw
tcacgtactacacgaccggtgctcgatttagctacgctctaagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaatgaacgacctgagagtcgaggacacggccgtctattactgtgcgaaagatgcagagagggccccgtaatggggccgtggtggagggttcttc

SEQ ID NO: 450558 - DNA, 505 bp, Homo sapiens
  misc_feature: HEFZJCU01D6E8U.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaagggctggagtgggttggccatattaaaatcaaagctgatggtgggacaacagagcacgctgcacccgtgaaaggcagattcagcatctcaagagatgattacaaaagtacgctgtatctgaacatagaacagcctagaaacggaggaacacagccgtagtattactgtgccactcgaggaccgatattgtt

SEQ ID NO: 450559 - DNA, 507 bp, Homo sapiens
  misc_feature: HEFZJCU01D9KJI.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtcaccgtctcctcagcctccaccaagggcccatcggtcttcccctggcaccctcctccaagagcacctctgggggcacagcggccctgggctgcctggtcaaggactacttcctactcgtat

SEQ ID NO: 450560 - DNA, 400 bp, Homo sapiens; identical to SEQ ID NO: 444452
  misc_feature: HEFZJCU01C7LDZ.47.24.C02.1.454.heavy.3.raw

SEQ ID NO: 450561 - DNA, 407 bp, Homo sapiens
  misc_feature: HEFZJCU01BV5CC.53.62.F07.1.454.heavy.3.raw
cgcgtatacacacgaccggtgctcgatttagtagtcgcataaagggaaaggggcttgagtgggtggcagttatgtactatgatggaagtaataaatattatgcagacttcgtgaagggccgattcaccatctccagagacagttccaaggacatcctgtatctccaaatgaacagcctgagacccgaggacacggctgtctactactgtgcgagggggggactagatttggtggctacgatcacccccatttttttgacttttctggggccagggaaccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 450562 - DNA, 346 bp, Homo sapiens
  misc_feature: HEFZJCU01C40B8.8.12.B01.1.454.heavy.3.raw
ctcgcgtgtccacgaccggtgctcgatttagtagtgtagatttggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaatgacctctggggccagggaaccctggtcaccgtctcctcagcctccaccaagggcccatcggtcttccccctggcgccctgctccaggagcacctccgagagcacagcggccctgggctgcctggtcaggactacttccgacacgcgag

SEQ ID NO: 450563 - DNA, 506 bp, Homo sapiens
  misc_feature: HEFZJCU01CF62J.49.49.E05.1.454.heavy.3.raw
agtcgagagacacgaccggtgctcgatttagagcgactagcaacacacaaagggggctttctgagagtcatggatctcatgtgcaagaaagtgaagcacctgtggttcttcctcctgctggtggcggctcccagatgggtcctgtcccagctgcagctacaggagtcgggcccaggactgctgaagccttcggagaccctgtccctcacctgcactgtctctggtggttccttcagtagtccttattactactggggctgggtccgccagcccccagggaagggcctggagtggattgcgaatatctactatagtgggagcacctactacaatccttccctcaagagtcgcgtcactgtgtccgtggacacgtccaagaataaagtctccctgaacctgaactctgtgaccgccgcagacacggctgtctattactgtgccagaacgcggaaatccctacacaatgatgcttttgatgtctggggccatgggacaatggtcaccgt

SEQ ID NO: 450564 - DNA, 517 bp, Homo sapiens
  misc_feature: HEFZJCU01BQ23A.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggcc

SEQ ID NO: 450565 - DNA, 509 bp, Homo sapiens
  misc_feature: HEFZJCU01C1KWH.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtgccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctcaggagcacctccgacgagcacagcggcctcggg

SEQ ID NO: 450566 - DNA, 504 bp, Homo sapiens
  misc_feature: HEFZJCU01A7QXH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggccctttgacttctc

SEQ ID NO: 450567 - DNA, 409 bp, Homo sapiens
  misc_feature: HEFZJCU01BAJXU.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttcccctggcgccctggctccaggtagcacctctggggcacagcggccctgggctgcctggtcaaggactacttccgagtgcgtct

SEQ ID NO: 450568 - DNA, 380 bp, Homo sapiens
  misc_feature: HEFZJCU01ED86G.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctaccgtgagct

SEQ ID NO: 450569 - DNA, 489 bp, Homo sapiens; identical to SEQ ID NO: 444791
  misc_feature: HEFZJCU01DL2J3.47.85.H08.1.454.heavy.3.raw

SEQ ID NO: 450570 - DNA, 501 bp, Homo sapiens
  misc_feature: HEFZJCU01CJ1WN.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccagagcacctctgggacacagcggccctggctgcctggtcaaggactacttcctacgtcgtat

SEQ ID NO: 450571 - DNA, 486 bp, Homo sapiens
  misc_feature: HEFZJCU01CU0ET.40.71.G05.1.454.heavy.3.raw
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagcctgacatctgacgacacggccgtatattactgtgcgagagatcgcacgtggggcggtagcgttcgac

SEQ ID NO: 450572 - DNA, 395 bp, Homo sapiens; identical to SEQ ID NO: 444517
  misc_feature: HEFZJCU01BHO8P.16.68.G02.1.454.heavy.3.raw

SEQ ID NO: 450573 - DNA, 500 bp, Homo sapiens; identical to SEQ ID NO: 445028
  misc_feature: HEFZJCU01DZ7HJ.13.12.B01.1.454.heavy.3.raw

SEQ ID NO: 450574 - DNA, 535 bp, Homo sapiens
  misc_feature: HEFZJCU01CWLS2.14.57.F02.1.454.heavy.3.raw
  modified_base (385)..(385): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgatacccaatttggaggggcctttcatgtctgggccaagggacgctggtcaccgtctcttcagcctccaccaaggcccatcggtcttcccctggcaccctcctccaagagcacctctcgggggcacagcc

SEQ ID NO: 450575 - DNA, 500 bp, Homo sapiens
  misc_feature: HEFZJCU01D6EG2.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggcagggacaatggtcaccgt

SEQ ID NO: 450576 - DNA, 432 bp, Homo sapiens
  misc_feature: HEFZJCU01D6PQ4.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggtcaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 450577 - DNA, 492 bp, Homo sapiens; identical to SEQ ID NO: 444827
  misc_feature: HEFZJCU01EQ8IY.4.28.C06.1.454.heavy.3.raw

SEQ ID NO: 450578 - DNA, 529 bp, Homo sapiens
  misc_feature: HEFZJCU01C8229.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgaggtagggccagctgctgggagcgtctacatatttcgaccccctggggcccagggaacccaggtcaccgtctcctcagcctccaccaagggccccatccgtcttcccctggcgccctcgctcccaggacgcacctcccgagagcacagcggccctgggctgcctggtcaaggactaccttcctacg

SEQ ID NO: 450579 - DNA, 527 bp, Homo sapiens
  misc_feature: HEFZJCU01CH0YP.8.10.A10.1.454.heavy.3.raw
ctcgcgtgtccacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactgggccagggatccctggtcaccgtctcctcagcctccaccaagggcccatcggtcttcccctggcaccctcctccaagagcacctctgggggcacagcggccctgggctgcctggtcaaggactacttccgacacgcgacg

SEQ ID NO: 450580 - DNA, 511 bp, Homo sapiens; identical to SEQ ID NO: 445840
  misc_feature: HEFZJCU01EXG1Z.11.13.B02.1.454.heavy.3.raw

SEQ ID NO: 450581 - DNA, 492 bp, Homo sapiens; identical to SEQ ID NO: 446787
  misc_feature: HEFZJCU01CRYF8.4.7.A07.1.454.heavy.3.raw

SEQ ID NO: 450582 - DNA, 529 bp, Homo sapiens
  misc_feature: HEFZJCU01BZTU0.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagcgtggttttccgtgttaggctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacc

SEQ ID NO: 450583 - DNA, 387 bp, Homo sapiens
  misc_feature: HEFZJCU01AG8NF.11.20.B09.1.454.heavy.3.raw
cgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagtctccaccaagggcccatcggtcttccccctggcaccctcctccaagagcacctctgggggcacagcggccctgggctgcctggtcaaggactacttccgtatctctcg

SEQ ID NO: 450584 - DNA, 492 bp, Homo sapiens; identical to SEQ ID NO: 444827
  misc_feature: HEFZJCU01B4UL2.4.28.C06.1.454.heavy.3.raw

SEQ ID NO: 450585 - DNA, 490 bp, Homo sapiens
  misc_feature: HEFZJCU01AQH0B.51.1.A01.1.454.heavy.3.raw
cgatcgtatacacgaccggtgctcgatttagacgtctcatcaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggactaac

SEQ ID NO: 450586 - DNA, 546 bp, Homo sapiens
  misc_feature: HEFZJCU01DER5E.52.57.F02.1.454.heavy.3.raw
cgcagtacgacacgaccggtgctcgatttagctcgatatagttgggtttgggctgagcgtggcgtctttacgttgtggctattttaaaaggtgtccagtgtgacgtacagctggtggagtcggggggagccttccaacacccgggggggccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaaggggaccacgggtcaccgtcgcctcagcctccaccaagggcccatcggtcttccccctggccaccctcctccaagag

SEQ ID NO: 450587 - DNA, 390 bp, Homo sapiens; identical to SEQ ID NO: 444654
  misc_feature: HEFZJCU01B37WL.16.17.B06.1.454.heavy.3.raw

SEQ ID NO: 450588 - DNA, 503 bp, Homo sapiens
  misc_feature: HEFZJCU01BHBMF.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggccaagggacacg

SEQ ID NO: 450589 - DNA, 511 bp, Homo sapiens
  misc_feature: HEFZJCU01BH0WC.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggcccg

SEQ ID NO: 450590 - DNA, 511 bp, Homo sapiens; identical to SEQ ID NO: 445840
  misc_feature: HEFZJCU01DKZ0L.11.13.B02.1.454.heavy.3.raw

SEQ ID NO: 450591 - DNA, 535 bp, Homo sapiens
  misc_feature: HEFZJCU01DMOFX.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttatcgttactttgactactggggccagggaaccaggtcaccgtct

SEQ ID NO: 450592 - DNA, 489 bp, Homo sapiens; identical to SEQ ID NO: 444791
  misc_feature: HEFZJCU01EHD3D.47.85.H08.1.454.heavy.3.raw

SEQ ID NO: 450593 - DNA, 495 bp, Homo sapiens
  misc_feature: HEFZJCU01BKAY5.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccaggagcacctc

SEQ ID NO: 450594 - DNA, 532 bp, Homo sapiens
  misc_feature: HEFZJCU01B6SW9.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacgggtgactacgtgggggttcgaccccgtgggggcccaggggaaccctggtcaccgtctcctcagcctccaccg

SEQ ID NO: 450595 - DNA, 504 bp, Homo sapiens
  misc_feature: HEFZJCU01D1CP5.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaaactacctt

SEQ ID NO: 450596 - DNA, 525 bp, Homo sapiens
  misc_feature: HEFZJCU01CSAC3.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggctagtttattactgtgcaagaggcttgtggtcgactgtcgacctggactggtactcgatctggtggggccgtggcacccgt

SEQ ID NO: 450597 - DNA, 505 bp, Homo sapiens
  misc_feature: HEFZJCU01C97NF.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgttattactgtacgaaagaggggggatacagtggcagctccaagtactta

SEQ ID NO: 450598 - DNA, 504 bp, Homo sapiens
  misc_feature: HEFZJCU01CLKJF.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaattttcgttattgttctggtgtgtgtgttcatgtttgaccattc

SEQ ID NO: 450599 - DNA, 500 bp, Homo sapiens; identical to SEQ ID NO: 447017
  misc_feature: HEFZJCU01DQ8KL.13.12.B01.1.454.heavy.3.raw

SEQ ID NO: 450600 - DNA, 314 bp, Homo sapiens; identical to SEQ ID NO: 444774
  misc_feature: HEFZJCU01B7EQF.7.10.A10.1.454.heavy.3.raw

SEQ ID NO: 450601 - DNA, 528 bp, Homo sapiens
  misc_feature: HEFZJCU01COIFK.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaccgtttgacttttggggtccagggaaccctggtcaccgtctcctcagcctcaccaagggcccatcggtcttcccctggcaccctcctccagagcacctctggggcacagcggccctggctgcctc

SEQ ID NO: 450602 - DNA, 533 bp, Homo sapiens
  misc_feature: HEFZJCU01D7Q47.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaacggg

SEQ ID NO: 450603 - DNA, 448 bp, Homo sapiens
  misc_feature: HEFZJCU01EWLPD.10.38.D05.1.454.heavy.3.raw
catagtagtgcacgaccggtgctcgatttagtatctgatagttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttcccctggcgccctgctccaggagcacctccgagagcacagcggccctgggctgcctggtcaaggactacttcccactactatg

SEQ ID NO: 450604 - DNA, 506 bp, Homo sapiens
  misc_feature: HEFZJCU01BEJFD.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgacttcg

SEQ ID NO: 450605 - DNA, 509 bp, Homo sapiens
  misc_feature: HEFZJCU01DII39.40.65.F10.1.454.heavy.3.raw
  modified_base (486)..(486): a, c, t, g, unknown or other
tctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctcttcngcctccaccaacgggcccagtcc

SEQ ID NO: 450606 - DNA, 526 bp, Homo sapiens
  misc_feature: HEFZJCU01CRCXI.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagcttccaccaagggcccatcggtcttcccccg

SEQ ID NO: 450607 - DNA, 510 bp, Homo sapiens
  misc_feature: HEFZJCU01A3YUD.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgccttggtcaaggactacttcctacgtcgtat

SEQ ID NO: 450608 - DNA, 507 bp, Homo sapiens
  misc_feature: HEFZJCU01EZNKN.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctcgactgataaaccggactggttccgaccccgtcgggccgacgggacccgtggtccaccgtctcctc

SEQ ID NO: 450609 - DNA, 490 bp, Homo sapiens; identical to SEQ ID NO: 444500
  misc_feature: HEFZJCU01EFJPS.19.53.E09.1.454.heavy.3.raw

SEQ ID NO: 450610 - DNA, 498 bp, Homo sapiens; identical to SEQ ID NO: 449824
  misc_feature: HEFZJCU01A35GV.47.38.D05.1.454.heavy.3.raw

SEQ ID NO: 450611 - DNA, 495 bp, Homo sapiens; identical to SEQ ID NO: 449745
  misc_feature: HEFZJCU01DB02K.12.2.A02.1.454.heavy.3.raw

SEQ ID NO: 450612 - DNA, 492 bp, Homo sapiens
  misc_feature: HEFZJCU01CULUS.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtgggtttcctcgttagctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtgcgattatatcacatgatggaactaatagacgctatgccgatccgtgaagggccgattcaccatctccagagacaattccaagaacacgcagtatctgcaaatgaacagcctgagagctgaggacacggctgtgtattacgtgtgggagagatggaggtcgatattgt

SEQ ID NO: 450613 - DNA, 501 bp, Homo sapiens
  misc_feature: HEFZJCU01E1XPM.48.69.G03.1.454.heavy.3.raw
agtatacatacacgaccggtgctcgatttagtcgctgcgtaaaggagaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtattttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgattgcctttgatatgtggggccgaagggacaat

SEQ ID NO: 450614 - DNA, 509 bp, Homo sapiens
  misc_feature: HEFZJCU01BEMZC.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccaagggacactggtcaccgtctcttcagcctccaccaagggcccatcggtcttccccctggccgccctcgctccaggacg

SEQ ID NO: 450615 - DNA, 521 bp, Homo sapiens; identical to SEQ ID NO: 445358
  misc_feature: HEFZJCU01EWXEB.12.71.G05.1.454.heavy.3.raw

SEQ ID NO: 450616 - DNA, 512 bp, Homo sapiens
  misc_feature: HEFZJCU01BISPU.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtccg

SEQ ID NO: 450617 - DNA, 504 bp, Homo sapiens
  misc_feature: HEFZJCU01DMSGF.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaacccctggtcaccgtctcctcagcttccaccaagggcccatcggtcttcccctggcgccctgctccaggagcacctctggggc

SEQ ID NO: 450618 - DNA, 356 bp, Homo sapiens; identical to SEQ ID NO: 444460
  misc_feature: HEFZJCU01EY5OI.47.38.D05.1.454.heavy.3.raw

SEQ ID NO: 450619 - DNA, 506 bp, Homo sapiens; identical to SEQ ID NO: 444696
  misc_feature: HEFZJCU01EV7YE.16.34.D01.1.454.heavy.3.raw

SEQ ID NO: 450620 - DNA, 503 bp, Homo sapiens
  misc_feature: HEFZJCU01BQJNN.17.78.H01.1.454.heavy.3.raw
  modified_base (465)..(465): a, c, t, g, unknown or other
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatattactgtgcgngagatggctggcacagaggcacaactggctcgaccccg

SEQ ID NO: 450621 - DNA, 408 bp, Homo sapiens; identical to SEQ ID NO: 446115
  misc_feature: HEFZJCU01BT54F.51.71.G05.1.454.heavy.3.raw

SEQ ID NO: 450622 - DNA, 384 bp, Homo sapiens; identical to SEQ ID NO: 444454
  misc_feature: HEFZJCU01DGNRK.11.61.F06.1.454.heavy.3.raw

SEQ ID NO: 450623 - DNA, 379 bp, Homo sapiens; identical to SEQ ID NO: 444450
  misc_feature: HEFZJCU01C74RM.47.77.G11.1.454.heavy.3.raw

SEQ ID NO: 450624 - DNA, 491 bp, Homo sapiens; identical to SEQ ID NO: 447981
  misc_feature: HEFZJCU01ESTDF.47.85.H08.1.454.heavy.3.raw

SEQ ID NO: 450625 - DNA, 523 bp, Homo sapiens
  misc_feature: HEFZJCU01C08YS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaagggctcgagtgggtggcacttattgcacatgatggcgtcaacaaattctacgcaaattccgtgaggggccgattcaccatctccagagacaattacaagaacaccctttatcctgcaaatagacagccctgagaccagacgacacggctgtctattattgcgcgagagagacacacgaacctactggccaatactatgggggcttggttctgggggccaggggaccctggtcatcgtctccccagcctccaccaagggcccatcggtctcccctggcg

SEQ ID NO: 450626 - DNA, 511 bp, Homo sapiens
  misc_feature: HEFZJCU01DVYGM.47.55.E11.1.454.heavy.3.raw
  modified_base (450)..(450): a, c, t, g, unknown or other
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggntgtctatcattgtgtttcgatgccttcggtccgcgggacttcgtggggccagggaaccctc

SEQ ID NO: 450627 - DNA, 503 bp, Homo sapiens
  misc_feature: HEFZJCU01EWXC4.52.78.H01.1.454.heavy.3.raw
cgcagtacgacacgaccggtgctcgatttagtgtgagtagttgggtttggggctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttcttgggatgttgtcgttgcacc

SEQ ID NO: 450628 - DNA, 498 bp, Homo sapiens
  misc_feature: HEFZJCU01DTN8B.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaaccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccgtctcctcacgcctccacc

SEQ ID NO: 450629 - DNA, 392 bp, Homo sapiens; identical to SEQ ID NO: 444456
  misc_feature: HEFZJCU01E0FH9.7.60.F05.1.454.heavy.3.raw

SEQ ID NO: 450630 - DNA, 531 bp, Homo sapiens
  misc_feature: HEFZJCU01AMN0X.49.45.E01.1.454.heavy.3.raw
agtcgagagacacgaccggtgctcgatttagtgagtcagtaagggaaaggggtctgggagaggagccccagccgtgagattcccaggagattccacttggtgatcagcactgaacacagacctccaaccatggagtttgggcttagctgcgttttccttgttgctattttaaaaggtgtccattgtgaggtgcagctggttgagtctgggggaggcttggtacagcccgggcggtccctgagactctcctgtgtaacctcaggattcatctttggtgattatggaatgacctgggtccgccaggctccagggaagggcctggagtgggtagctttcgttagcagaaagactgaaggtgggacaacagaatacggcgcgtctgtgaaaggcagatttatcatctcaagagacgaattccaaaggcatcgcctatctgcaatgaacagcctgaaaaccgaggacacagccgtgtattttgtactagaggtacttcttgtattaccatgatactagtggttttacgaggtaggc

SEQ ID NO: 450631 - DNA, 495 bp, Homo sapiens; identical to SEQ ID NO: 445359
  misc_feature: HEFZJCU01A117O.4.21.B10.1.454.heavy.3.raw

SEQ ID NO: 450632 - DNA, 525 bp, Homo sapiens; identical to SEQ ID NO: 445545
  misc_feature: HEFZJCU01AM03I.12.86.H09.1.454.heavy.3.raw

SEQ ID NO: 450633 - DNA, 384 bp, Homo sapiens; identical to SEQ ID NO: 444454
  misc_feature: HEFZJCU01CT2TT.11.61.F06.1.454.heavy.3.raw

SEQ ID NO: 450634 - DNA, 491 bp, Homo sapiens; identical to SEQ ID NO: 445333
  misc_feature: HEFZJCU01A0XV0.19.53.E09.1.454.heavy.3.raw

SEQ ID NO: 450635 - DNA, 521 bp, Homo sapiens
  misc_feature: HEFZJCU01DZHJY.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccctggcgccctgctccaggagcacctccgagagcacagcggccc

SEQ ID NO: 450636 - DNA, 496 bp, Homo sapiens; identical to SEQ ID NO: 449899
  misc_feature: HEFZJCU01BHCON.4.21.B10.1.454.heavy.3.raw

SEQ ID NO: 450637 - DNA, 504 bp, Homo sapiens; identical to SEQ ID NO: 445222
  misc_feature: HEFZJCU01EG09B.9.33.C11.1.454.heavy.3.raw

SEQ ID NO: 450638 - DNA, 518 bp, Homo sapiens; identical to SEQ ID NO: 444718
  misc_feature: HEFZJCU01D38GL.9.34.D01.1.454.heavy.3.raw

SEQ ID NO: 450639 - DNA, 535 bp, Homo sapiens
  misc_feature: HEFZJCU01AMIKG.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagaggagggggagagtggagtagaacgtaaatacgggaaaccgtttgacttttggggccagggaaccctggtcaccgtctcctcagcctccaccaagggcccatcggtcttcccctggccaccctcctccaagagcacctcgtgggggcacagcggccctgggctgcctc

SEQ ID NO: 450640 - DNA, 395 bp, Homo sapiens; identical to SEQ ID NO: 444517
  misc_feature: HEFZJCU01BN0QD.16.68.G02.1.454.heavy.3.raw

SEQ ID NO: 450641 - DNA, 511 bp, Homo sapiens
  misc_feature: HEFZJCU01CNHSY.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgaacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgccg

SEQ ID NO: 450642 - DNA, 510 bp, Homo sapiens
  misc_feature: HEFZJCU01E05A9.52.83.H06.1.454.heavy.3.raw
cgcagtacgacacgaccggtgctcgatttagatcacgtgcgtcgcgggtctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacggggtgtttattactgtgcgaacttaattacggaggacaacggtaaccccgtccg

SEQ ID NO: 450643 - DNA, 509 bp, Homo sapiens
  misc_feature: HEFZJCU01DUH0L.9.86.H09.1.454.heavy.3.raw
tgatacgtctcacgaccggtgctcgatttagtgctatagacttgggtttgggctgagcgtgggttttcctcgttagctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctcgtgggccaagggacactggtcaccgtctcttcagcctccaccaagggccatcggtcttcccctggcgccctgcctccaggacg

SEQ ID NO: 450644 - DNA, 510 bp, Homo sapiens
  misc_feature: HEFZJCU01DQ1JR.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactacgtgggaccg

SEQ ID NO: 450645 - DNA, 516 bp, Homo sapiens
  misc_feature: HEFZJCU01BF7CE.53.74.G08.1.454.heavy.3.raw
cgcgtatacacacgaccggtgctcgatttagtagctctatcagggggagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtagagcctggggggtccctgagactctcctgtgcagcctctggattcacctttagcagctacgccatgagctgggtccgccaggctccagggaaggggctggagtgggtctcagcaattactggtggtggtggtagggcatactacgcagactccgtgaggggccggttcaccatctccagtgacaattccaagaacacgctgtatctgcaaatgaacagcctgagagccgaggacacggccgtttattactgtgcgaaacacatttttggactccttgccatagacgcctactactttgactacg

SEQ ID NO: 450646 - DNA, 498 bp, Homo sapiens
  misc_feature: HEFZJCU01EPMPJ.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctatgcttttgatatctgggccaagggac

SEQ ID NO: 450647 - DNA, 396 bp, Homo sapiens; identical to SEQ ID NO: 444426
  misc_feature: HEFZJCU01A0RUI.18.31.C09.1.454.heavy.3.raw

SEQ ID NO: 450648 - DNA, 491 bp, Homo sapiens; identical to SEQ ID NO: 444749
  misc_feature: HEFZJCU01ER8KH.11.13.B02.1.454.heavy.3.raw

SEQ ID NO: 450649 - DNA, 507 bp, Homo sapiens
  misc_feature: HEFZJCU01D0571.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggccaccctcctccaagagcacctctgggggcac

SEQ ID NO: 450650 - DNA, 480 bp, Homo sapiens
  misc_feature: HEFZJCU01CST51.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccaggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctgcgccctgctccaggagcacctccgagagcacagcggccctgggctgcctggtcaggactacttcccactactatg

SEQ ID NO: 450651 - DNA, 500 bp, Homo sapiens
  misc_feature: HEFZJCU01EKMOM.51.64.F09.1.454.heavy.3.raw
cgatcgtatacacgaccggtgctcgatttagcgcgtatacaagggggggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaacggaatgagtgggaactagggtttgagtaac

SEQ ID NO: 450652 - DNA, 500 bp, Homo sapiens; identical to SEQ ID NO: 446179
  misc_feature: HEFZJCU01CK6CJ.19.86.H09.1.454.heavy.3.raw

SEQ ID NO: 450653 - DNA, 509 bp, Homo sapiens
  misc_feature: HEFZJCU01B97NT.12.78.H01.1.454.heavy.3.raw
atacgacgtacacgaccggtgctcgatttagtgtgagtagtttgggtttgggggaggcttggtacagcctggggggtccccgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 450654 - DNA, 511 bp, Homo sapiens; identical to SEQ ID NO: 445268
  misc_feature: HEFZJCU01BBJAY.48.34.D01.1.454.heavy.3.raw

SEQ ID NO: 450655 - DNA, 371 bp, Homo sapiens; identical to SEQ ID NO: 444919
  misc_feature: HEFZJCU01DY4GW.3.1.A01.1.454.heavy.3.raw

SEQ ID NO: 450656 - DNA, 504 bp, Homo sapiens
  misc_feature: HEFZJCU01DIGTQ.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccac

SEQ ID NO: 450657 - DNA, 314 bp, Homo sapiens; identical to SEQ ID NO: 444774
  misc_feature: HEFZJCU01A2PM2.7.10.A10.1.454.heavy.3.raw

SEQ ID NO: 450658 - DNA, 410 bp, Homo sapiens; identical to SEQ ID NO: 445199
  misc_feature: HEFZJCU01AEILU.9.11.A11.1.454.heavy.3.raw

SEQ ID NO: 450659 - DNA, 510 bp, Homo sapiens
  misc_feature: HEFZJCU01EHT03.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaatagcctgagagccgacgacacggccatatattactgtgcgaaagcaccggcagttagtcacccatactactttgactactggggccg

SEQ ID NO: 450660 - DNA, 478 bp, Homo sapiens
  misc_feature: HEFZJCU01B7K41.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggccaccctcctccaagagcacctctgggggcacagcggccctgggctgcctggtcaaggactacttccgagtagtaca

SEQ ID NO: 450661 - DNA, 407 bp, Homo sapiens; identical to SEQ ID NO: 448569
  misc_feature: HEFZJCU01CSYT6.49.61.F06.1.454.heavy.3.raw

SEQ ID NO: 450662 - DNA, 508 bp, Homo sapiens
  misc_feature: HEFZJCU01EL7UW.17.25.C03.1.454.heavy.3.raw
  modified_base (468)..(468): a, c, t, g, unknown or other
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtnagcctacggcagcggcctttgacttctggggccagggacg

SEQ ID NO: 450663 - DNA, 505 bp, Homo sapiens
  misc_feature: HEFZJCU01EIVS7.21.4.A04.1.454.heavy.3.raw
  modified_base (455)..(455): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctgaaaaccgnggacacggccgtgtattattgtggtagacaaagagtggatgtggtggtag

SEQ ID NO: 450664 - DNA, 517 bp, Homo sapiens
  misc_feature: HEFZJCU01CMXQ1.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggcctttatttctgttgcaaaggtggaaccgacatatttcactaagcctggcactggtacttcg

SEQ ID NO: 450665 - DNA, 512 bp, Homo sapiens
  misc_feature: HEFZJCU01D43NG.51.77.G11.1.454.heavy.3.raw
  modified_base (486)..(486): a, c, t, g, unknown or other
cgatcgtatacacgaccggtgctcgatttagctagtcactcaagggaaaggggcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgaccccgtccgctcggtgcggaggtctggggccaagggaccacggtcatcgtctcctcagcctccaccaagggcccatcggtcttcccctggcaccctcctccaagagcacctctgggggcacngcgcctggctgcctggtcaaggacta

SEQ ID NO: 450666 - DNA, 386 bp, Homo sapiens
  misc_feature: HEFZJCU01BKG7U.47.77.G11.1.454.heavy.3.raw
agctcacgtacacgaccggtgctcgatttagctagtcactcaagggaaaggggctggagtgggtctctaggcatttggtggtagtggtgccaggacacattacgtaaagtccctgcagggccgattctttatctccagagacaatttccaggaacatacttagattctgcagttgaccagactgagagtcgaggacacgggccgtatattattgtgttaaagtgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 450667 - DNA, 501 bp, Homo sapiens
  misc_feature: HEFZJCU01BKKAL.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccccgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggccgccctgct

SEQ ID NO: 450668 - DNA, 505 bp, Homo sapiens
  misc_feature: HEFZJCU01B44L6.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggactactcctacgtcgtat

SEQ ID NO: 450669 - DNA, 531 bp, Homo sapiens
  misc_feature: HEFZJCU01C0Y8H.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctcg

SEQ ID NO: 450670 - DNA, 518 bp, Homo sapiens; identical to SEQ ID NO: 444718
  misc_feature: HEFZJCU01DWF6S.9.34.D01.1.454.heavy.3.raw

SEQ ID NO: 450671 - DNA, 524 bp, Homo sapiens; identical to SEQ ID NO: 445902
  misc_feature: HEFZJCU01EKDN6.9.78.H01.1.454.heavy.3.raw

SEQ ID NO: 450672 - DNA, 484 bp, Homo sapiens; identical to SEQ ID NO: 445876
  misc_feature: HEFZJCU01C5VPA.8.39.D06.1.454.heavy.3.raw

SEQ ID NO: 450673 - DNA, 515 bp, Homo sapiens; identical to SEQ ID NO: 447834
  misc_feature: HEFZJCU01DFTB6.3.20.B09.1.454.heavy.3.raw

SEQ ID NO: 450674 - DNA, 372 bp, Homo sapiens; identical to SEQ ID NO: 444578
  misc_feature: HEFZJCU01EMDSV.49.68.G02.1.454.heavy.3.raw

SEQ ID NO: 450675 - DNA, 519 bp, Homo sapiens
  misc_feature: HEFZJCU01CDZRH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctggggccaagggaccg

SEQ ID NO: 450676 - DNA, 412 bp, Homo sapiens
  misc_feature: HEFZJCU01CMRJ7.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacacttttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 450677 - DNA, 491 bp, Homo sapiens; identical to SEQ ID NO: 444592
  misc_feature: HEFZJCU01BY483.11.26.C04.1.454.heavy.3.raw

SEQ ID NO: 450678 - DNA, 482 bp, Homo sapiens; identical to SEQ ID NO: 444503
  misc_feature: HEFZJCU01BLZKI.7.10.A10.1.454.heavy.3.raw

SEQ ID NO: 450679 - DNA, 313 bp, Homo sapiens; identical to SEQ ID NO: 444518
  misc_feature: HEFZJCU01DUUN1.7.10.A10.1.454.heavy.3.raw

SEQ ID NO: 450680 - DNA, 536 bp, Homo sapiens
  misc_feature: HEFZJCU01D7FDP.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctggggaccg

SEQ ID NO: 450681 - DNA, 450 bp, Homo sapiens
  misc_feature: HEFZJCU01AT8MG.8.10.A10.1.454.heavy.3.raw
ctcgcgtgtccacgaccggtgctcgatttagcgtcgatctcaggggtccgggagatcatgagggtgtccttgggttttggggggaagaggaagactgacggtccccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccgggggaaacttgactactggggccagggatccctggtcaccgtctcctcagcctccaccaagggcccatcggtcttcccctggcaccctcctccaagagcacctctgggggcacagcggccctgggctgcctggtcaaggactacttccgacacgcgag

SEQ ID NO: 450682 - DNA, 396 bp, Homo sapiens; identical to SEQ ID NO: 444469
  misc_feature: HEFZJCU01CNMNT.47.46.E02.1.454.heavy.3.raw

SEQ ID NO: 450683 - DNA, 396 bp, Homo sapiens; identical to SEQ ID NO: 444469
  misc_feature: HEFZJCU01DW0L7.47.46.E02.1.454.heavy.3.raw

SEQ ID NO: 450684 - DNA, 332 bp, Homo sapiens
  misc_feature: HEFZJCU01EOHAS.40.81.H04.1.454.heavy.3.raw
tctagcgactcacgaccggtgctcgatttagtagtgtagattcgcgggtgtccttgggttttgggggaagaggaagactgacggtcctgccacagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 450685 - DNA, 509 bp, Homo sapiens; identical to SEQ ID NO: 444586
  misc_feature: HEFZJCU01CFH5E.12.78.H01.1.454.heavy.3.raw

SEQ ID NO: 450686 - DNA, 456 bp, Homo sapiens
  misc_feature: HEFZJCU01CPM99.53.81.H04.1.454.heavy.3.raw
cgcgtatacacacgaccggtgctcgatttagtagtgtagattcgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgtttatagtgggagctgcccaagatcgccattccactttgactactggggccagggaacactggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 450687 - DNA, 511 bp, Homo sapiens; identical to SEQ ID NO: 446675
  misc_feature: HEFZJCU01EN5PR.4.23.C01.1.454.heavy.3.raw

SEQ ID NO: 450688 - DNA, 510 bp, Homo sapiens
  misc_feature: HEFZJCU01BXDBU.53.70.G04.1.454.heavy.3.raw
cgcgtatacacacgaccggtgctcgatttagtgtagtgtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaaggactactt

SEQ ID NO: 450689 - DNA, 430 bp, Homo sapiens
  misc_feature: HEFZJCU01C9FS9.40.34.D01.1.454.heavy.3.raw
tctagcgactcacgaccggtgctcgatttagatcgtctgtgttgggttttgggtacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 450690 - DNA, 453 bp, Homo sapiens
  misc_feature: HEFZJCU01DARRM.40.57.F02.1.454.heavy.3.raw
tctagcgactcacgaccggtgctcgatttagctcgatatagttgggtttgggattcacgttgcagatgtagggctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggccagggaaccctggtcaccgtctcctcagcctccaccaagggcccatcggtcttcccctggcaccctcctccaagagcacctctgggggcacagcggccctgggctgcctggtcaaggactacttccagtcgctaga

SEQ ID NO: 450691 - DNA, 396 bp, Homo sapiens; identical to SEQ ID NO: 444469
  misc_feature: HEFZJCU01DJW9U.47.46.E02.1.454.heavy.3.raw

SEQ ID NO: 450692 - DNA, 511 bp, Homo sapiens; identical to SEQ ID NO: 445268
  misc_feature: HEFZJCU01EYMWW.48.34.D01.1.454.heavy.3.raw

SEQ ID NO: 450693 - DNA, 485 bp, Homo sapiens
  misc_feature: HEFZJCU01C2QBG.53.15.B04.1.454.heavy.3.raw
cgcgtatacacacgaccggtgctcgatttagacagtatatatccgcgggggctctgggagaggagcccagcactagaagtcggcggtgtttccattcggtgatcagcactgaacacagaggactcagcatggagtttgggctgagctgggttttcctcgttgctcttttaagaggtgtccagtgtcaggtgcaactggtggagtctgggggaggcgtggtccagcctgggaagtcactgcgactctcctgtgcagcctctggattcagcttcagctcgtatgcgatgcactgggtccgccaggctccaggcaaggggctggagtgggtggcggttatttcacatgatggaagtcaggaatattatgcagactccgtgaggggccgattcaccatctcccgagacaattccaagaacacagtggatctgcaaatgagtagcatgagagttggggacacggcggtgtattactgtgcgaaggcttgg

SEQ ID NO: 450694 - DNA, 519 bp, Homo sapiens; identical to SEQ ID NO: 445330
  misc_feature: HEFZJCU01B6FT8.7.78.H01.1.454.heavy.3.raw

SEQ ID NO: 450695 - DNA, 513 bp, Homo sapiens
  misc_feature: HEFZJCU01BHI0E.4.67.G01.1.454.heavy.3.raw
  modified_base (476)..(476): a, c, t, g, unknown or other
  modified_base (503)..(503): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattacngtgcgaaagatctcgggctgggttccncggtccggga

SEQ ID NO: 450696 - DNA, 525 bp, Homo sapiens
  misc_feature: HEFZJCU01DZ7JU.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccgagggaaccctggtcaccgtctcctcagcctccaccaagggcccatcggtcttcccctggcgccctgctccaggagcacctccgagagcacagcggccctcgggctgcctggtcaaggactacttcc

SEQ ID NO: 450697 - DNA, 529 bp, Homo sapiens
  misc_feature: HEFZJCU01CHNXN.8.34.D01.1.454.heavy.3.raw
ctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtattggagctgaacagcctaagtcctgaggacacgggcgtatactactgtacgaaggagggggaaccagcgggagttccaagtactcctttgacgtctggggccagggtaccctggtcaccgtctcctcagcctccaccaagggcccatcggtcttcccctggcgccctgctccaggagcacctccgagagcacg

SEQ ID NO: 450698 - DNA, 518 bp, Homo sapiens
  misc_feature: HEFZJCU01D03PG.3.26.C04.1.454.heavy.3.raw
agacgcactccacgaccggtgctcgatttagtctagcgactttgggtttgggctgacctgggttttcctcgttgctcttttaagaggtgtccagtgtcaggtgcagctggtggagtctgggggaggcgtggtccagcctgggaggtccctgagactctcctgtgcagcctctgaattcaccttcagtaattatgctatgcactgggtccgccaggctccgggcaaggggccggagtgggtggcagttatatcttatgatggaaagagtgagtactacgcagactccgtgcagggccgatttatcatctccagagacagtctcaagaacaccctatatctgcaaatgaacagcctgagacctgaggacacggctctatattactgtgcgagagaggcgtcgggaccgatagccgtggctgggacttttgactactggggccagggaaccctggtcaccatctcctcagcctccaccaagggcccatccggtcttccccctggccaccctcctccaagag

SEQ ID NO: 450699 - DNA, 356 bp, Homo sapiens; identical to SEQ ID NO: 444460
  misc_feature: HEFZJCU01CFL5F.47.38.D05.1.454.heavy.3.raw

SEQ ID NO: 450700 - DNA, 497 bp, Homo sapiens
  misc_feature: HEFZJCU01CGSCK.10.28.C06.1.454.heavy.3.raw
catagtagtgcacgaccggtgctcgatttagagctcacgtattgggtttggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaaatagggtctacgattactcattctgactactgggccagggaaccctggtcaccgtctcctcagcctccaccaagggcccatcggtcttcccctggcgcctgctccacggagcacctccgagagcacagcggccctggctgcctgtcaaggactacttcccactactatg

SEQ ID NO: 450701 - DNA, 546 bp, Homo sapiens
  misc_feature: HEFZJCU01BWSP0.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcacccgtgaaaggaagattcaccatctcaagagataattcaaaacgacggtgtatttgcaaatgaacagcctgaaaaccgaggacacagccgtctattactgtaccacagattcgggaagtgcatcgacgtaaaggaggctatgcttttgatatctggggcccaggggacaattc

SEQ ID NO: 450702 - DNA, 502 bp, Homo sapiens
  misc_feature: HEFZJCU01AF3LW.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaatgaacagcctgactgccggggacactgccgtgtattactgtgccagcagcagcacctggccactatatttcttt

SEQ ID NO: 450703 - DNA, 501 bp, Homo sapiens
  misc_feature: HEFZJCU01BGGFG.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccctggcgccctgctccaggagcacctccgagagcacagcggccctgggctgcctggtcaaggactacttcctacgtcgtat

SEQ ID NO: 450704 - DNA, 544 bp, Homo sapiens
  misc_feature: HEFZJCU01C8PLO.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaagggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggttggagtcggggagtttggttcctgggggccagggaaccctggtctaccg

SEQ ID NO: 450705 - DNA, 511 bp, Homo sapiens
  misc_feature: HEFZJCU01DMVQJ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccaccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaccatactactttgactactggggccg

SEQ ID NO: 450706 - DNA, 378 bp, Homo sapiens; identical to SEQ ID NO: 444419
  misc_feature: HEFZJCU01C83NI.47.77.G11.1.454.heavy.3.raw

SEQ ID NO: 450707 - DNA, 497 bp, Homo sapiens
  misc_feature: HEFZJCU01D76X3.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacact

SEQ ID NO: 450708 - DNA, 440 bp, Homo sapiens
  misc_feature: HEFZJCU01A42GL.19.25.C03.1.454.heavy.3.raw
tactctcgtgcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttggttttggggggaagaggaagactgacggtccccccaggagttcaggtgctgggcacagcggccctgggctgcctggtcaaggactacttcccacgagagta

SEQ ID NO: 450709 - DNA, 483 bp, Homo sapiens
  misc_feature: HEFZJCU01BW086.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctccacatcggttta

SEQ ID NO: 450710 - DNA, 339 bp, Homo sapiens
  misc_feature: HEFZJCU01BO3BR.53.8.A08.1.454.heavy.3.raw
cgcgtatacacacgaccggtgctcgatttagcatactctacagggccgattcaccatctccagagacaattccaagaacaccctgtatctgcaattgagcagactcacagctgaggacacggctgtgtattactgtgtgaaagacgtttatgagagtagtggtttttccgagtacgcacattacggtatggacgtctggggccaagggaccccggtcaccgtctccttagcctccaccaagggcccatcggtcttccccctggcaccctcctccaagagcacctctgggggcacagcggccctgggctgcctggtcaaggactacttcctcgtactgcg

SEQ ID NO: 450711 - DNA, 494 bp, Homo sapiens
  misc_feature: HEFZJCU01DENZR.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccagggcccatcggtcttcccctggcgcctgctccaggagcacctccgagagcacagcggcctggctgcctgtcaaggctactccacta

SEQ ID NO: 450712 - DNA, 507 bp, Homo sapiens
  misc_feature: HEFZJCU01DFGZU.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctcggcaccctcctccaagagcacctctgggggcacagcggccctgggctgcctggtcaaggactacttcctagtacgtga

SEQ ID NO: 450713 - DNA, 437 bp, Homo sapiens
  misc_feature: HEFZJCU01CQ3GX.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagtttgacagctggggccagggaaccctggtcaccgtctcctcagcctccaccaagggcccatcggtcttccccctggccgccctgctccaggagcacctccgagagcacagcggccctgggctgcctggtcaaggactacttccgagtgcgtct

SEQ ID NO: 450714 - DNA, 531 bp, Homo sapiens
  misc_feature: HEFZJCU01BVGO5.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaac

SEQ ID NO: 450715 - DNA, 520 bp, Homo sapiens; identical to SEQ ID NO: 446666
  misc_feature: HEFZJCU01DE2L7.7.78.H01.1.454.heavy.3.raw

SEQ ID NO: 450716 - DNA, 503 bp, Homo sapiens; identical to SEQ ID NO: 445995
  misc_feature: HEFZJCU01ARX0E.17.25.C03.1.454.heavy.3.raw

SEQ ID NO: 450717 - DNA, 507 bp, Homo sapiens; identical to SEQ ID NO: 448078
  misc_feature: HEFZJCU01DFWLJ.21.35.D02.1.454.heavy.3.raw

SEQ ID NO: 450718 - DNA, 525 bp, Homo sapiens
  misc_feature: HEFZJCU01B9HWB.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactacgtgggggccaggggaagctttggtcaccgtctcctcagccct

SEQ ID NO: 450719 - DNA, 533 bp, Homo sapiens
  misc_feature: HEFZJCU01DMN09.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttcccctggcaccctcctccaagagcacctctc

SEQ ID NO: 450720 - DNA, 525 bp, Homo sapiens
  misc_feature: HEFZJCU01DQGEH.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctgcgcctgctccaggagcacctccgagacg

SEQ ID NO: 450721 - DNA, 484 bp, Homo sapiens
  misc_feature: HEFZJCU01C5MFS.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccataacg

SEQ ID NO: 450722 - DNA, 396 bp, Homo sapiens
  misc_feature: HEFZJCU01CNNH0.16.68.G02.1.454.heavy.3.raw
tgtactactccacgaccggtgctcgatttagtcgatagtgaagggaaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 450723 - DNA, 504 bp, Homo sapiens
  misc_feature: HEFZJCU01D1O1X.52.81.H04.1.454.heavy.3.raw
cgcagtacgacacgaccggtgctcgatttagtagtgtagattcgcggggagctctgagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagctgctgcagtcgggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttctgtacgaagaatacacacagctggacgaggagaccg

SEQ ID NO: 450724 - DNA, 495 bp, Homo sapiens; identical to SEQ ID NO: 445359
  misc_feature: HEFZJCU01C8S60.4.21.B10.1.454.heavy.3.raw

SEQ ID NO: 450725 - DNA, 477 bp, Homo sapiens; identical to SEQ ID NO: 444659
  misc_feature: HEFZJCU01B4XHT.16.10.A10.1.454.heavy.3.raw

SEQ ID NO: 450726 - DNA, 508 bp, Homo sapiens
  misc_feature: HEFZJCU01BBPN5.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggttgagtgggaattaggggctgagtacggtatggacgtctggggccaagggaccacggtcaccgtctcct

SEQ ID NO: 450727 - DNA, 395 bp, Homo sapiens; identical to SEQ ID NO: 444494
  misc_feature: HEFZJCU01AROH3.47.46.E02.1.454.heavy.3.raw

SEQ ID NO: 450728 - DNA, 507 bp, Homo sapiens
  misc_feature: HEFZJCU01CXJUL.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 450729 - DNA, 522 bp, Homo sapiens
  misc_feature: HEFZJCU01EVU9D.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaacggg

SEQ ID NO: 450730 - DNA, 390 bp, Homo sapiens; identical to SEQ ID NO: 444541
  misc_feature: HEFZJCU01ECD87.16.24.C02.1.454.heavy.3.raw

SEQ ID NO: 450731 - DNA, 500 bp, Homo sapiens; identical to SEQ ID NO: 444529
  misc_feature: HEFZJCU01DILQA.12.38.D05.1.454.heavy.3.raw

SEQ ID NO: 450732 - DNA, 507 bp, Homo sapiens
  misc_feature: HEFZJCU01D75ST.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagccggcctttgactttcgtc

SEQ ID NO: 450733 - DNA, 517 bp, Homo sapiens; identical to SEQ ID NO: 446078
  misc_feature: HEFZJCU01D9FVI.9.34.D01.1.454.heavy.3.raw

SEQ ID NO: 450734 - DNA, 510 bp, Homo sapiens; identical to SEQ ID NO: 445542
  misc_feature: HEFZJCU01EUBK0.16.21.B10.1.454.heavy.3.raw

SEQ ID NO: 450735 - DNA, 511 bp, Homo sapiens; identical to SEQ ID NO: 446799
  misc_feature: HEFZJCU01D8YR9.18.39.D06.1.454.heavy.3.raw

SEQ ID NO: 450736 - DNA, 505 bp, Homo sapiens
  misc_feature: HEFZJCU01CNZDH.51.24.C02.1.454.heavy.3.raw
cgatcgtatacacgaccggtgctcgatttagtacagatcgttagggaaagggggctctgggagaggagcccagcactagaagtcggcggtgtttccattcggtgatcagcactgaacacagacgactcaccatggactttgggctgagctgggttttcctcgttgctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatgaagggccgatccaccatctccagggacaattccaagaacacactgtatctgcaaataaacaacctgagagttgcggacacggctgtctattactgtgcggcactgggggactacggtgacaacgt

SEQ ID NO: 450737 - DNA, 492 bp, Homo sapiens
  misc_feature: HEFZJCU01EIW3L.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttg

SEQ ID NO: 450738 - DNA, 532 bp, Homo sapiens
  misc_feature: HEFZJCU01BO7QL.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtcctcaagagtcgagtaacgatctcagtgacacgtctaacaatcacctctccctgaggctgagctctgtgacagccgcggacacgggcgtttattactgtgcgagacggggacggactacggtgactacgtgggggttccgacccctggggccaggggaaccctgggtccaccgtctcctcagccctccaaccg

SEQ ID NO: 450739 - DNA, 509 bp, Homo sapiens
  misc_feature: HEFZJCU01DWBRN.48.34.D01.1.454.heavy.3.raw
  modified_base (476)..(476): a, c, t, g, unknown or other
agtatacatacacgaccggtgctcgatttagatcgtctgtgttgggtttggggggtctcagagaggagccttagccctggactccaaggcctttccacttggtgatcagcactgagcacagaggactcaccatggaattggggctgagcgtgggttttccttgttagctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtgggccaagggacaacggtcaccgtctcttcagcctccaccaagggcccatcggtcttcccctggcgccctgctccagngcacctccgagagcacagcgccctgggctgccg

SEQ ID NO: 450740 - DNA, 508 bp, Homo sapiens
  misc_feature: HEFZJCU01AUUDL.2.33.C11.1.454.heavy.3.raw
acgctcgacacacgaccggtgctcgatttagagtgagctcgttgggtttgggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcg

SEQ ID NO: 450741 - DNA, 515 bp, Homo sapiens
  misc_feature: HEFZJCU01DKI2N.48.35.D02.1.454.heavy.3.raw
agtatacatacacgaccggtgctcgatttagcacacgatagttgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaggggcccatcggtcttccccctggcgccctgctccaggagcacctccgagagcacagcggccctgggctgcctggtcaaggactactcctatgta

SEQ ID NO: 450742 - DNA, 505 bp, Homo sapiens
  misc_feature: HEFZJCU01CRW89.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctcgctccacggagcacctccgacgagcacagcggccctgggctgcctggtcaaggactacttcctatcgtatact

SEQ ID NO: 450743 - DNA, 481 bp, Homo sapiens
  misc_feature: HEFZJCU01BR3W8.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgagggagta

SEQ ID NO: 450744 - DNA, 512 bp, Homo sapiens
  misc_feature: HEFZJCU01BJ11N.51.13.B02.1.454.heavy.3.raw
cgatcgtatacacgaccggtgctcgatttagtctagcgacttccgcggggacccaaaaaccacacccctccttgggagaatcccctagatcacagctcctcaccatggactggccctggaacatccttttcttggtggcagcagcaacaggtgcccactccgaggctcagctggtgcagtctggacctgaggtgcagaagcctggggcctcagtgaaagtctcctgcagggcctctgatttcaccttttccaactatggtttcgcttgggtgcgacaggcccctggacagggcctggagtggctgggatggatcagcactgacagactgaatattaattatgcacagggtctccagggcagagtcaccgtgtccgcagacacgtccacgggcacgggcctatatggaattgaggagcctcagatatgacgacacggccgtgtattactgtgccagaggggccgtttgggggagttagtggtccctgtgctttggatgtctggggccaaggga

SEQ ID NO: 450745 - DNA, 481 bp, Homo sapiens; identical to SEQ ID NO: 445517
  misc_feature: HEFZJCU01B1TH3.22.36.D03.1.454.heavy.3.raw

SEQ ID NO: 450746 - DNA, 527 bp, Homo sapiens
  misc_feature: HEFZJCU01BFAB6.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggaccgcgacgagttcgactactc

SEQ ID NO: 450747 - DNA, 518 bp, Homo sapiens; identical to SEQ ID NO: 448852
  misc_feature: HEFZJCU01BME2X.16.10.A10.1.454.heavy.3.raw

SEQ ID NO: 450748 - DNA, 521 bp, Homo sapiens
  misc_feature: HEFZJCU01EE0J1.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 450749 - DNA, 383 bp, Homo sapiens; identical to SEQ ID NO: 444673
  misc_feature: HEFZJCU01CXO41.11.61.F06.1.454.heavy.3.raw

SEQ ID NO: 450750 - DNA, 506 bp, Homo sapiens; identical to SEQ ID NO: 444696
  misc_feature: HEFZJCU01DOCZD.16.34.D01.1.454.heavy.3.raw

SEQ ID NO: 450751 - DNA, 521 bp, Homo sapiens; identical to SEQ ID NO: 445317
  misc_feature: HEFZJCU01C1N0Z.12.40.D07.1.454.heavy.3.raw

SEQ ID NO: 450752 - DNA, 517 bp, Homo sapiens
  misc_feature: HEFZJCU01DO95V.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccagaacgttactacgctatggacgtctggggccaagggaccg

SEQ ID NO: 450753 - DNA, 384 bp, Homo sapiens
  misc_feature: HEFZJCU01E00J5.13.42.D09.1.454.heavy.3.raw
tcacgtactacacgaccggtgctcgatttagacacatacgcagggaaaggggctggtgtgggtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctctggggccaggggacaatggtaaccgtctcttcagcctccaccaagggcccatcggtcttccccctggcgccctgctccaggagcacctccgagagcacagcggccctgggctgcctggtcaaggactacttcctagtacgtga

SEQ ID NO: 450754 - DNA, 493 bp, Homo sapiens; identical to SEQ ID NO: 447050
  misc_feature: HEFZJCU01D8Y1J.10.71.G05.1.454.heavy.3.raw

SEQ ID NO: 450755 - DNA, 506 bp, Homo sapiens; identical to SEQ ID NO: 446520
  misc_feature: HEFZJCU01A9RPW.10.38.D05.1.454.heavy.3.raw

SEQ ID NO: 450756 - DNA, 521 bp, Homo sapiens
  misc_feature: HEFZJCU01ANGKI.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagacctaagtcctgaggacacgggtgtatactactgtacgaagggaggggggaaccgagcgggagttaccaagtactccg

SEQ ID NO: 450757 - DNA, 501 bp, Homo sapiens
  misc_feature: HEFZJCU01DPAVW.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgacaaatgaacagcctgagagccgacgacacggccatatattactgtgcgaaagcaccggcagttagcacccatactactttgact

SEQ ID NO: 450758 - DNA, 395 bp, Homo sapiens; identical to SEQ ID NO: 444517
  misc_feature: HEFZJCU01EHQ38.16.68.G02.1.454.heavy.3.raw

SEQ ID NO: 450759 - DNA, 505 bp, Homo sapiens; identical to SEQ ID NO: 448716
  misc_feature: HEFZJCU01E2EII.16.34.D01.1.454.heavy.3.raw

SEQ ID NO: 450760 - DNA, 513 bp, Homo sapiens; identical to SEQ ID NO: 447518
  misc_feature: HEFZJCU01A05RI.19.67.G01.1.454.heavy.3.raw

SEQ ID NO: 450761 - DNA, 494 bp, Homo sapiens
  misc_feature: HEFZJCU01DU3H6.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctgggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatattctgtgcgcgaggaattcgacttctgaatatacttggtgaactactta

SEQ ID NO: 450762 - DNA, 378 bp, Homo sapiens; identical to SEQ ID NO: 444463
  misc_feature: HEFZJCU01AWK9L.47.77.G11.1.454.heavy.3.raw

SEQ ID NO: 450763 - DNA, 465 bp, Homo sapiens; identical to SEQ ID NO: 445921
  misc_feature: HEFZJCU01A2G6X.48.34.D01.1.454.heavy.3.raw

SEQ ID NO: 450764 - DNA, 542 bp, Homo sapiens
  misc_feature: HEFZJCU01A3Y2Q.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatctggggcccaggggacaa

SEQ ID NO: 450765 - DNA, 396 bp, Homo sapiens; identical to SEQ ID NO: 444469
  misc_feature: HEFZJCU01AUF5B.47.46.E02.1.454.heavy.3.raw

SEQ ID NO: 450766 - DNA, 458 bp, Homo sapiens
  misc_feature: HEFZJCU01CMOY1.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcacgtctcctcagcctccaccaagggcccatcggtcttcccctggcaccctcctccaagagcacctctgggggcacagcggccctgggctgcctggtcaaggactacttcctcgtactgcg

SEQ ID NO: 450767 - DNA, 410 bp, Homo sapiens
  misc_feature: HEFZJCU01A7RKO.3.41.D08.1.454.heavy.3.raw
agacgcactccacgaccggtgctcgatttagtcacgcgagaaagggaaaggggcgtggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccggggatcttgactactggggccaggggaccctggtcaccgtctcctcagcttccaccaagggcccatcggtcttccccctggcgccctgctccaggagcacctctgggggcacagcggccctgggctgcctggtcaggactacttccgagtgcgtct

SEQ ID NO: 450768 - DNA, 373 bp, Homo sapiens; identical to SEQ ID NO: 445969
  misc_feature: HEFZJCU01A54J8.49.58.F03.1.454.heavy.3.raw

SEQ ID NO: 450769 - DNA, 488 bp, Homo sapiens; identical to SEQ ID NO: 447044
  misc_feature: HEFZJCU01C4KOG.18.70.G04.1.454.heavy.3.raw

SEQ ID NO: 450770 - DNA, 494 bp, Homo sapiens
  misc_feature: HEFZJCU01CDNJY.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagtcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccac

SEQ ID NO: 450771 - DNA, 383 bp, Homo sapiens; identical to SEQ ID NO: 445880
  misc_feature: HEFZJCU01C199U.22.46.E02.1.454.heavy.3.raw

SEQ ID NO: 450772 - DNA, 538 bp, Homo sapiens
  misc_feature: HEFZJCU01AVGGI.49.26.C04.1.454.heavy.3.raw
agtcgagagacacgaccggtgctcgatttagtctagcgactttgggtttgggggagtctccttcaccacccagctgggatctcagggcttccttttctgtcctcctccaggatggggtcaaccgccatcctcgccctcctcctggctgttctccaaggggtctgtgccgaggtgcaactggtgcagtccggagcagaagtgaaaagcccggggagtctctgaggatctcctgtaagatttctggagacaccttaaccacctattggatcagctgggtgcgccagatgcccggtaaaggcctggaatggatggggatgattgatcccagtgactcttttaccacgtacggcccgtccttccaatggcacgtcaccatctcagctgacaagtcccaaaggagtgcctccctggagtggaccagcctgagggcctcggacaccgccatgtattactgtgcaatggggtcgggggagcagtgtctggcaattattactactactctgtggacgtctggggccgaggggacctcggtctaccg

SEQ ID NO: 450773 - DNA, 488 bp, Homo sapiens
  misc_feature: HEFZJCU01A738K.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtccctcagcctccaccaagggcccatcggtcttcccctggcgccctgctccaggagcacctccgagagcacagcggccctgggctgcctggtcaaggactacttcctacgtgagct

SEQ ID NO: 450774 - DNA, 516 bp, Homo sapiens; identical to SEQ ID NO: 447339
  misc_feature: HEFZJCU01BQUBZ.46.67.G01.1.454.heavy.3.raw

SEQ ID NO: 450775 - DNA, 524 bp, Homo sapiens
  misc_feature: HEFZJCU01AV5DG.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctccccaccctccaccaagggcccatcggtcttcccctggcaccctcctccagagcacctctgggggcacagcggccctgggctgcctggtcaaggactacttcccatactcgta

SEQ ID NO: 450776 - DNA, 492 bp, Homo sapiens; identical to SEQ ID NO: 444695
  misc_feature: HEFZJCU01D4S1Y.3.34.D01.1.454.heavy.3.raw

SEQ ID NO: 450777 - DNA, 410 bp, Homo sapiens
  misc_feature: HEFZJCU01CB705.3.41.D08.1.454.heavy.3.raw
agacgcactccacgaccggtgctcgatttagtcacgcgagaaagggaaaggggcgtggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgagtttttggagtggttattatactccccgggatcttgactactggggccaggggaccctggtcaccgtctcctcagcttccaccaagggcccatcggtcttccccctggcgccctgctccaggagcacctctggggcacagcggccctgggctgcctggtcaaggactacttccgagtgcgtct

SEQ ID NO: 450778 - DNA, 534 bp, Homo sapiens
  misc_feature: HEFZJCU01CTLSZ.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtctaccg

SEQ ID NO: 450779 - DNA, 495 bp, Homo sapiens
  misc_feature: HEFZJCU01CCUKU.48.78.H01.1.454.heavy.3.raw
agtatacatacacgaccggtgctcgatttagtgtgagtagtttgggtttggggaggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccaggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccct

SEQ ID NO: 450780 - DNA, 384 bp, Homo sapiens; identical to SEQ ID NO: 444492
  misc_feature: HEFZJCU01BMUN4.18.60.F05.1.454.heavy.3.raw

SEQ ID NO: 450781 - DNA, 379 bp, Homo sapiens
  misc_feature: HEFZJCU01DQBKQ.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcaaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcgaccctgggctgcctggtcaaggactacttcctacgtgagct

SEQ ID NO: 450782 - DNA, 396 bp, Homo sapiens; identical to SEQ ID NO: 444469
  misc_feature: HEFZJCU01DWR1J.47.46.E02.1.454.heavy.3.raw

SEQ ID NO: 450783 - DNA, 519 bp, Homo sapiens
  misc_feature: HEFZJCU01END40.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggccgaagggaccg

SEQ ID NO: 450784 - DNA, 481 bp, Homo sapiens
  misc_feature: HEFZJCU01CYX3G.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtggaagggactgctggggccagggagcccttgtcaccgtctcctcagcctccaccaagggcccatcggtcttcccctggcgccctgctccaggagcacctccgagagcacagcggccctgggctgcctggtcaaggactacttccactactatg

SEQ ID NO: 450785 - DNA, 535 bp, Homo sapiens; identical to SEQ ID NO: 448705
  misc_feature: HEFZJCU01CDYTF.17.28.C06.1.454.heavy.3.raw

SEQ ID NO: 450786 - DNA, 514 bp, Homo sapiens
  misc_feature: HEFZJCU01ASGJV.52.26.C04.1.454.heavy.3.raw
cgcagtacgacacgaccggtgctcgatttagtctagcgactttgggtttgggaggtctcggagaggagccttagccctggactccaaggcctttccacttggtgatcagcactgagcacagaggactcaccatggagttggggctgagctgggttttccttgttgctattttagaaggtgtccagtgtgaggcgcaggctggtggaggtctgggggaggcttggtccagtctggggggtccctgacactctcctgtgtagcctctggattcacctttaacagtttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccacg

SEQ ID NO: 450787 - DNA, 513 bp, Homo sapiens
  misc_feature: HEFZJCU01EMHU0.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctggggcacagcggcccg

SEQ ID NO: 450788 - DNA, 507 bp, Homo sapiens
  misc_feature: HEFZJCU01B050Z.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaacccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 450789 - DNA, 432 bp, Homo sapiens; identical to SEQ ID NO: 444920
  misc_feature: HEFZJCU01BP7G0.11.39.D06.1.454.heavy.3.raw

SEQ ID NO: 450790 - DNA, 508 bp, Homo sapiens
  misc_feature: HEFZJCU01EWKVL.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacagatcac

SEQ ID NO: 450791 - DNA, 506 bp, Homo sapiens; identical to SEQ ID NO: 446124
  misc_feature: HEFZJCU01BF6CV.48.44.D11.1.454.heavy.3.raw

SEQ ID NO: 450792 - DNA, 518 bp, Homo sapiens; identical to SEQ ID NO: 444718
  misc_feature: HEFZJCU01D5Q2F.9.34.D01.1.454.heavy.3.raw

SEQ ID NO: 450793 - DNA, 520 bp, Homo sapiens
  misc_feature: HEFZJCU01B29I5.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttcccctggcgccctgctccaggagcacctcccgagagcacagcggccctgggctgcctggtcaaggactactcctacg

SEQ ID NO: 450794 - DNA, 476 bp, Homo sapiens
  misc_feature: HEFZJCU01EE7N2.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtctccccctggcaccctcctccaagagcacctctgggggcacagcggccctgggctgcctggtcaaggactacttccgagtagtaca

SEQ ID NO: 450795 - DNA, 536 bp, Homo sapiens
  misc_feature: HEFZJCU01CYU52.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaactacgccctggcgctatggacgtctggggccaagggaccacggtcaccgtctcctcagcctccaccaagggcccatcggtcttcccctc

SEQ ID NO: 450796 - DNA, 471 bp, Homo sapiens; identical to SEQ ID NO: 444988
  misc_feature: HEFZJCU01DNWVJ.48.1.A01.1.454.heavy.3.raw

SEQ ID NO: 450797 - DNA, 529 bp, Homo sapiens
  misc_feature: HEFZJCU01DSF1I.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccaggggaagctttggtcctaccgtctcctcagcctcccg

SEQ ID NO: 450798 - DNA, 394 bp, Homo sapiens
  misc_feature: HEFZJCU01DIJA4.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatggggctcaaaccaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 450799 - DNA, 534 bp, Homo sapiens
  misc_feature: HEFZJCU01BTTDL.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgtttattggggccagggagccctggtctaccg

SEQ ID NO: 450800 - DNA, 528 bp, Homo sapiens
  misc_feature: HEFZJCU01BGPUU.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcccgtgacgactacggcctgtagttggcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 450801 - DNA, 347 bp, Homo sapiens
  misc_feature: HEFZJCU01EQBZ0.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagca

SEQ ID NO: 450802 - DNA, 483 bp, Homo sapiens; identical to SEQ ID NO: 444924
  misc_feature: HEFZJCU01B5D1Y.10.35.D02.1.454.heavy.3.raw

SEQ ID NO: 450803 - DNA, 540 bp, Homo sapiens
  misc_feature: HEFZJCU01CH09C.52.57.F02.1.454.heavy.3.raw
cgcagtacgacacgaccggtgctcgatttagctcgatatagttgggtttggactgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtcttcccctggccaccctcctccaagag

SEQ ID NO: 450804 - DNA, 405 bp, Homo sapiens
  misc_feature: HEFZJCU01D6CD6.52.35.D02.1.454.heavy.3.raw
cgcagtacgacacgaccggtgctcgatttagcacacgatagttgggtttgggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 450805 - DNA, 515 bp, Homo sapiens
  misc_feature: HEFZJCU01EJKPW.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgcttttggagtggttacgccgcgtttgactactggggccagggaaccctggtcaccgtctcctcagcctccaccaac

SEQ ID NO: 450806 - DNA, 490 bp, Homo sapiens
  misc_feature: HEFZJCU01D8VMZ.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccatcggtcttcccctggcgccctgctccaggagcacctccgagagcacagcggccctgggctgcctggtcaaggctacttccctacagtgct

SEQ ID NO: 450807 - DNA, 502 bp, Homo sapiens
  misc_feature: HEFZJCU01BCOW6.48.26.C04.1.454.heavy.3.raw
agtatacatacacgaccggtgctcgatttagtctagcgactttgggtttggggctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgaccctgggccagggaaccctggtcaccgt

SEQ ID NO: 450808 - DNA, 509 bp, Homo sapiens
  misc_feature: HEFZJCU01EWBB9.17.25.C03.1.454.heavy.3.raw
cgtagactagcacgaccggtgctcgatttagtagtgtagatttgggtttggggaaccacatctgtcctctagagaaaaccctgtgagcacagctactcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtggggccagggacg

SEQ ID NO: 450809 - DNA, 513 bp, Homo sapiens; identical to SEQ ID NO: 447518
  misc_feature: HEFZJCU01ANJ64.19.67.G01.1.454.heavy.3.raw

SEQ ID NO: 450810 - DNA, 491 bp, Homo sapiens; identical to SEQ ID NO: 445531
  misc_feature: HEFZJCU01EIWD1.11.38.D05.1.454.heavy.3.raw

SEQ ID NO: 450811 - DNA, 479 bp, Homo sapiens; identical to SEQ ID NO: 450171
  misc_feature: HEFZJCU01D72O7.14.70.G04.1.454.heavy.3.raw

SEQ ID NO: 450812 - DNA, 492 bp, Homo sapiens; identical to SEQ ID NO: 444827
  misc_feature: HEFZJCU01DVLBL.4.28.C06.1.454.heavy.3.raw

SEQ ID NO: 450813 - DNA, 482 bp, Homo sapiens; identical to SEQ ID NO: 444503
  misc_feature: HEFZJCU01ELAZF.7.10.A10.1.454.heavy.3.raw

SEQ ID NO: 450814 - DNA, 472 bp, Homo sapiens
  misc_feature: HEFZJCU01EC0W4.49.12.B01.1.454.heavy.3.raw
agtcgagagacacgaccggtgctcgatttagtagtgtagattccgcgggcacgaccggtgctcgatttagtagtgtagattccgcgggcacgaccggtgctcgatttagtctgatcgagaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 450815 - DNA, 385 bp, Homo sapiens; identical to SEQ ID NO: 444438
  misc_feature: HEFZJCU01ECEWZ.18.60.F05.1.454.heavy.3.raw

SEQ ID NO: 450816 - DNA, 507 bp, Homo sapiens
  misc_feature: HEFZJCU01DUVC7.21.4.A04.1.454.heavy.3.raw
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccgccaggctccagggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctgaaaaccgaggacacggccgtgtattattgtggtagacaaaagagtggatgtggtggtag

SEQ ID NO: 450817 - DNA, 499 bp, Homo sapiens
  misc_feature: HEFZJCU01DCGQR.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctggggaggcttggtgcagccgggtgggtccctgcgactctcctgtgcaatttctgaagcccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgtttctgcaaatgaacagcctggaagacgcggacacagccatgtattattgtacattaggacactatacg

SEQ ID NO: 450818 - DNA, 518 bp, Homo sapiens
  misc_feature: HEFZJCU01B4LVH.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaagggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccacgggaccctggtcaccgtctcctcag

SEQ ID NO: 450819 - DNA, 423 bp, Homo sapiens; identical to SEQ ID NO: 444772
  misc_feature: HEFZJCU01CHSYA.16.78.H01.1.454.heavy.3.raw

SEQ ID NO: 450820 - DNA, 518 bp, Homo sapiens
  misc_feature: HEFZJCU01CPLIK.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatattcgaccctggggccagggaacccaggtcaccgtctcctcagcctccaccaagggcccatccgtcttcccctggcgccctgctccaggagcacctccgagagcacagcggccctgggctgcctggcaaggactacttcctacg

SEQ ID NO: 450821 - DNA, 505 bp, Homo sapiens
  misc_feature: HEFZJCU01DMRHA.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccaggaagggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgtcgagcgacccggggctcctcaatggctttcattcg

SEQ ID NO: 450822 - DNA, 534 bp, Homo sapiens
  misc_feature: HEFZJCU01EC77I.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagccggcccgtcgggcgtcgcctggtcgaaggactacttccaacg

SEQ ID NO: 450823 - DNA, 526 bp, Homo sapiens
  misc_feature: HEFZJCU01CSEZN.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 450824 - DNA, 495 bp, Homo sapiens
  misc_feature: HEFZJCU01DV7WG.10.71.G05.1.454.heavy.3.raw
  modified_base (386)..(386): a, c, t, g, unknown or other
  modified_base (466)..(466): a, c, t, g, unknown or other
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtggtttcgtcgttaggcgtctttaagtaggatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatggggtggcagatatacaatatgatgacagtaaaatatactatggaagactccttnaagggccgattcaccatctccagagacaattccaagaacatggtgtatctgcaaatgaccagcctgaagagccgaggacncggtgtttaattctgtgggagaatcagtg

SEQ ID NO: 450825 - DNA, 519 bp, Homo sapiens; identical to SEQ ID NO: 444867
  misc_feature: HEFZJCU01DN5VN.9.34.D01.1.454.heavy.3.raw

SEQ ID NO: 450826 - DNA, 381 bp, Homo sapiens
  misc_feature: HEFZJCU01BN7T4.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtagttaaatgggatggtggctacgactcgttggggaccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 450827 - DNA, 409 bp, Homo sapiens; identical to SEQ ID NO: 444519
  misc_feature: HEFZJCU01B8FTS.3.41.D08.1.454.heavy.3.raw

SEQ ID NO: 450828 - DNA, 500 bp, Homo sapiens; identical to SEQ ID NO: 446033
  misc_feature: HEFZJCU01CO1NF.11.27.C05.1.454.heavy.3.raw

SEQ ID NO: 450829 - DNA, 506 bp, Homo sapiens; identical to SEQ ID NO: 444696
  misc_feature: HEFZJCU01EJFBR.16.34.D01.1.454.heavy.3.raw

SEQ ID NO: 450830 - DNA, 493 bp, Homo sapiens
  misc_feature: HEFZJCU01BVT8J.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtattgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctggggcacagcggcctgggctgcctggtcaaggactacttccgagtagtaca

SEQ ID NO: 450831 - DNA, 514 bp, Homo sapiens
  misc_feature: HEFZJCU01CZ7O1.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccggtct

SEQ ID NO: 450832 - DNA, 505 bp, Homo sapiens
  misc_feature: HEFZJCU01CV50P.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctccgagagcacagcggcctgggctgcctggtcaaggactacttccgagtagtaca

SEQ ID NO: 450833 - DNA, 504 bp, Homo sapiens
  misc_feature: HEFZJCU01EILY9.17.33.C11.1.454.heavy.3.raw
  modified_base (494)..(494): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgnagcctccacc

SEQ ID NO: 450834 - DNA, 536 bp, Homo sapiens
  misc_feature: HEFZJCU01EKTSI.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaacgggcccatcggtcttcccctggcaccctcctccaagagcacctctgggggcacagcggccctgggctgcctggt

SEQ ID NO: 450835 - DNA, 518 bp, Homo sapiens; identical to SEQ ID NO: 444718
  misc_feature: HEFZJCU01EJYFC.9.34.D01.1.454.heavy.3.raw

SEQ ID NO: 450836 - DNA, 390 bp, Homo sapiens
  misc_feature: HEFZJCU01AQBF5.13.86.H09.1.454.heavy.3.raw
tcacgtactacacgaccggtgctcgatttagtgctatagacttgggtttgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtcttccccctggcaccctcctccaagagcacctctggggcacagcggccctgggctgcctggtcaaggactacttcctagtacgtga

SEQ ID NO: 450837 - DNA, 520 bp, Homo sapiens
  misc_feature: HEFZJCU01EJXML.48.38.D05.1.454.heavy.3.raw
agtatacatacacgaccggtgctcgatttagtatctgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccccgtggggccagggactaccgtggtcctaccg

SEQ ID NO: 450838 - DNA, 530 bp, Homo sapiens
  misc_feature: HEFZJCU01BA64W.14.57.F02.1.454.heavy.3.raw
cgtctagtaccacgaccggtgctcgatttagctcgatatagttgggtttgggctgagttgggctcgttcttagtggctattttaaaagatgtccagtgtgaggtgcagctgctggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggccgtttcatgtctggggccaagggacgctggtcaccgtctcttcagcctccaccaagggcccatccggtcttccccctggccaccctcctccaagagcacctc

SEQ ID NO: 450839 - DNA, 519 bp, Homo sapiens
  misc_feature: HEFZJCU01A5J06.14.76.G10.1.454.heavy.3.raw
cgtctagtaccacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 450840 - DNA, 523 bp, Homo sapiens
  misc_feature: HEFZJCU01BH4CV.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactacttccgtgtctgat

SEQ ID NO: 450841 - DNA, 481 bp, Homo sapiens; identical to SEQ ID NO: 445006
  misc_feature: HEFZJCU01CX0I4.7.10.A10.1.454.heavy.3.raw

SEQ ID NO: 450842 - DNA, 516 bp, Homo sapiens
  misc_feature: HEFZJCU01EZ6D4.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgttcttcaaatgaacagcctgagagccgatgacacggccgtgtattactgtgcgagagatggggcccacgaacgttactacgctatggacgtcgtggggcc

SEQ ID NO: 450843 - DNA, 510 bp, Homo sapiens
  misc_feature: HEFZJCU01AJE1Q.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttagtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattaggtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 450844 - DNA, 502 bp, Homo sapiens
  misc_feature: HEFZJCU01E0O83.10.12.B01.1.454.heavy.3.raw
catagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccatctactttgtgcgactagaagtgggagctataggggatttgta

SEQ ID NO: 450845 - DNA, 520 bp, Homo sapiens
  misc_feature: HEFZJCU01EGXIC.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctcggcaccctcctccaagagcacctctgggggcacagcggccctgggctgcctggtcaaggactacttccgagtagtacac

SEQ ID NO: 450846 - DNA, 383 bp, Homo sapiens
  misc_feature: HEFZJCU01D8SG3.47.29.C07.1.454.heavy.3.raw
agctcacgtacacgaccggtgctcgatttagagtgctacgaagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctggggcacagcggccctgggctgcctggtcaaggactacttcctacgtgagct

SEQ ID NO: 450847 - DNA, 489 bp, Homo sapiens; identical to SEQ ID NO: 444791
  misc_feature: HEFZJCU01ETY7G.47.85.H08.1.454.heavy.3.raw

SEQ ID NO: 450848 - DNA, 506 bp, Homo sapiens; identical to SEQ ID NO: 445864
  misc_feature: HEFZJCU01CVUBJ.13.37.D04.1.454.heavy.3.raw

SEQ ID NO: 450849 - DNA, 528 bp, Homo sapiens
  misc_feature: HEFZJCU01ETXVP.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcttttacacctccttgacttctggggccatcggaaccccggtccg

SEQ ID NO: 450850 - DNA, 505 bp, Homo sapiens; identical to SEQ ID NO: 444927
  misc_feature: HEFZJCU01DUMQC.17.31.C09.1.454.heavy.3.raw

SEQ ID NO: 450851 - DNA, 430 bp, Homo sapiens; identical to SEQ ID NO: 444675
  misc_feature: HEFZJCU01EQPIA.40.34.D01.1.454.heavy.3.raw

SEQ ID NO: 450852 - DNA, 499 bp, Homo sapiens
  misc_feature: HEFZJCU01C1UYY.9.76.G10.1.454.heavy.3.raw
tgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgatggaattaaaaatactatgcagactccgtgaagggccgattcaccatctccagagacaactccaagaacacgctgtttctgcaaatgaacagcctgagagctgaggacacggctgtgtatttctgtgctcaagataggtgggacttcggattcttggagtggt

SEQ ID NO: 450853 - DNA, 522 bp, Homo sapiens
  misc_feature: HEFZJCU01EI1X6.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacggaaccgtttactacgctatggtaaccgtcgtgggggaccg

SEQ ID NO: 450854 - DNA, 484 bp, Homo sapiens
  misc_feature: HEFZJCU01CG5LH.53.50.E06.1.454.heavy.3.raw
cgcgtatacacacgaccggtgctcgatttagatctactgacaacacacaaggggtctgggagaggagcccagcactagaagtcggcggtgtttccattcggtgatcagcactgaacacagaggactcaccatggagtttgggctgagctgggtcttcctcgttgctcttttaagaggtgtccagtgccaggtgcagttggtggagtctgggggaggcgtggtccagcctgggcggtccctgagactctcctgtgcagcctctggattcaccttcagagtctatggcatgaactgggtccgccaggctccaggcaaggggctggagtgggtggcacttatactagatgatggaagtaataaatattatgcagactccgtgaagggccgattcaccatctccagagacaattccaagaacactctgtatctgcaaatgaacagcctgagacctgaggacacggctgtctactactgtgcgaacggt

SEQ ID NO: 450855 - DNA, 467 bp, Homo sapiens
  misc_feature: HEFZJCU01BWGS8.16.78.H01.1.454.heavy.3.raw
tgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctacaccaagggcccatcggtcttccccctggcaccctcctccaagagcacctctgggggcacagcggccctgggctgcctggtcaaggactacttccgagtagtaca

SEQ ID NO: 450856 - DNA, 400 bp, Homo sapiens
  misc_feature: HEFZJCU01EFV6G.47.77.G11.1.454.heavy.3.raw
agctcacgtacacgaccggtgctcgatttagctagtcactcaagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 450857 - DNA, 520 bp, Homo sapiens
  misc_feature: HEFZJCU01AUHKC.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagacgacacg

SEQ ID NO: 450858 - DNA, 514 bp, Homo sapiens
  misc_feature: HEFZJCU01BEO95.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagccacccatacctactttgactactggggccaac

SEQ ID NO: 450859 - DNA, 512 bp, Homo sapiens
  misc_feature: HEFZJCU01D1Q3Y.19.67.G01.1.454.heavy.3.raw
  modified_base (483)..(483): a, c, t, g, unknown or other
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacgattctacggagactccatggagggccgattcaccatctccagagacttttctcagaacacactgtctcttcaaatgaacagcctgaggccgaggacacggccgtctattattgtgtgagagtttanggcgatggcttgggtggacagatcacgtc

SEQ ID NO: 450860 - DNA, 378 bp, Homo sapiens
  misc_feature: HEFZJCU01A4LUU.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccggactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 450861 - DNA, 526 bp, Homo sapiens
  misc_feature: HEFZJCU01ARBQH.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgttacgagagcgtcgtctgtcagtggaattgactactgggccagggaaccctggtcaccgtctcctcagcctccacc

SEQ ID NO: 450862 - DNA, 502 bp, Homo sapiens
  misc_feature: HEFZJCU01CVL18.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgatgagcctacggcagcggcctttgacttctggggcca

SEQ ID NO: 450863 - DNA, 473 bp, Homo sapiens
  misc_feature: HEFZJCU01C5ND4.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctggagcggcctgacatctgacgacacggccgtatatttctgt

SEQ ID NO: 450864 - DNA, 507 bp, Homo sapiens
  misc_feature: HEFZJCU01D2D40.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcggctggttccgcggtccgggt

SEQ ID NO: 450865 - DNA, 549 bp, Homo sapiens
  misc_feature: HEFZJCU01BVKNK.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggatcgggggagttttggttcctgggggccaggggaaccctggtctaccg

SEQ ID NO: 450866 - DNA, 501 bp, Homo sapiens
  misc_feature: HEFZJCU01DDO0P.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcgacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 450867 - DNA, 532 bp, Homo sapiens
  misc_feature: HEFZJCU01CT7S3.49.71.G05.1.454.heavy.3.raw
agtcgagagacacgaccggtgctcgatttagtgtcgtcgcaagagagaggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcaagacatcggacaccgccacctattactgtgcacgacgccgttataccagaggctggtaccttgactcctggggccgtagggcaccctggtcaccgtctccctcacg

SEQ ID NO: 450868 - DNA, 501 bp, Homo sapiens
  misc_feature: HEFZJCU01EWA6F.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccgacctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 450869 - DNA, 383 bp, Homo sapiens; identical to SEQ ID NO: 444477
  misc_feature: HEFZJCU01B5DP2.47.60.F05.1.454.heavy.3.raw

SEQ ID NO: 450870 - DNA, 464 bp, Homo sapiens; identical to SEQ ID NO: 445062
  misc_feature: HEFZJCU01C17J1.19.10.A10.1.454.heavy.3.raw

SEQ ID NO: 450871 - DNA, 503 bp, Homo sapiens
  misc_feature: HEFZJCU01CAALB.51.71.G05.1.454.heavy.3.raw
cgatcgtatacacgaccggtgctcgatttagtgtcgtcgcaagagagaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggcctgggctgcctggtcaaggactacttcc

SEQ ID NO: 450872 - DNA, 534 bp, Homo sapiens; identical to SEQ ID NO: 446321
  misc_feature: HEFZJCU01BNKG1.22.38.D05.1.454.heavy.3.raw

SEQ ID NO: 450873 - DNA, 513 bp, Homo sapiens
  misc_feature: HEFZJCU01DMG1Q.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccg

SEQ ID NO: 450874 - DNA, 377 bp, Homo sapiens
  misc_feature: HEFZJCU01CWSME.3.26.C04.1.454.heavy.3.raw
agacgcactccacgaccggtgctcgatttagtctagcgactttgggtttgggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacttccgagtgcgt

SEQ ID NO: 450875 - DNA, 379 bp, Homo sapiens; identical to SEQ ID NO: 444450
  misc_feature: HEFZJCU01EXROI.47.77.G11.1.454.heavy.3.raw

SEQ ID NO: 450876 - DNA, 509 bp, Homo sapiens
  misc_feature: HEFZJCU01C58VQ.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgaggcagtgttcaatggtatgcagactccgtgaagggccgattcaccatctccagagacaattccaggaacacaatgtatttggaaatgaacagcctaagtcctgaggacacggtgtatactactgtacgaaggagggggaaccagcggagtccaagtactcctttg

SEQ ID NO: 450877 - DNA, 504 bp, Homo sapiens
  misc_feature: HEFZJCU01DYBT7.53.19.B08.1.454.heavy.3.raw
cgcgtatacacacgaccggtgctcgatttagtgagtcagtaaggggtctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtcggggggaggcgtggtccagcctgggaagtccctgagactctcctgtgcggcctctggattcagtttcagttggtacggcatgcactgggtccgtcaggctccaggcaaggggctggagtgggtggcaattatatcgtatgatggaaccaaaagaactacgcagactccgtgaagggccgcttcagtatctccagagacgatcgccgggacaccctttatttgcaaatgagcagcctgagagttggagacacggctgtatattactgtgcgagagacaaacctgaatatagcactggctggcaggg

SEQ ID NO: 450878 - DNA, 519 bp, Homo sapiens
  misc_feature: HEFZJCU01DL47I.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtcgtggggccaagggaccg

SEQ ID NO: 450879 - DNA, 512 bp, Homo sapiens
  misc_feature: HEFZJCU01B9OMF.19.85.H08.1.454.heavy.3.raw
tactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccaggaaaggggctggagtggattgcctatgccactagtgagggcgaagtcacgtcctacgcggactctgtgcggggccggtttaccatctccagagacaatgccaagaagacgctctttctgcaattggacggcctgagagtcgaagacacggctatttattactgtgtgagagaggggggcactggctggtcgggtcgagtcttttgt

SEQ ID NO: 450880 - DNA, 491 bp, Homo sapiens
  misc_feature: HEFZJCU01EJ7AO.53.10.A10.1.454.heavy.3.raw
cgcgtatacacacgaccggtgctcgatttagcgtcgatctcagggggcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactccccttatacattgggtacgacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatctgaggacacggccatgtattactgtgcgatcttagtggtattacgactacaatattttgtcacg

SEQ ID NO: 450881 - DNA, 490 bp, Homo sapiens
  misc_feature: HEFZJCU01A1OQS.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttcgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttcccatactcgta

SEQ ID NO: 450882 - DNA, 508 bp, Homo sapiens; identical to SEQ ID NO: 446002
  misc_feature: HEFZJCU01AVSWX.9.78.H01.1.454.heavy.3.raw

SEQ ID NO: 450883 - DNA, 503 bp, Homo sapiens
  misc_feature: HEFZJCU01B73BX.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 450884 - DNA, 512 bp, Homo sapiens; identical to SEQ ID NO: 445688
  misc_feature: HEFZJCU01CGCAU.3.34.D01.1.454.heavy.3.raw

SEQ ID NO: 450885 - DNA, 507 bp, Homo sapiens
  misc_feature: HEFZJCU01DOOUN.48.45.E01.1.454.heavy.3.raw
agtatacatacacgaccggtgctcgatttagtgagtcagtaagggaaaggggctgggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccgggggggcctggtaccgcctggggggtcccttagactctcctgtgcagcctctggattcatcttcagtaatgtctggatgacctggttccgccaggctccagggaagggctggagtgggttggccgtgttaaaaccaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgact

SEQ ID NO: 450886 - DNA, 396 bp, Homo sapiens; identical to SEQ ID NO: 444469
  misc_feature: HEFZJCU01DKV2R.47.46.E02.1.454.heavy.3.raw

SEQ ID NO: 450887 - DNA, 509 bp, Homo sapiens
  misc_feature: HEFZJCU01DR7VI.52.34.D01.1.454.heavy.3.raw
cgcagtacgacacgaccggtgctcgatttagatcgtctgtgttgggtttgggggaggcttggtaaagcggggggggtagtctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggccaccctcctccaagagcacctctgggggcacagcggccctgggctgcctggtcaaggactacttcctatacgatcg

SEQ ID NO: 450888 - DNA, 509 bp, Homo sapiens; identical to SEQ ID NO: 445824
  misc_feature: HEFZJCU01EUGMG.9.14.B03.1.454.heavy.3.raw

SEQ ID NO: 450889 - DNA, 515 bp, Homo sapiens
  misc_feature: HEFZJCU01DKP12.2.11.A11.1.454.heavy.3.raw
acgctcgacacacgaccggtgctcgatttagctacgactgcagggtgtacacctgtggttctcgggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccgggagatcatgagggtgtccttgggttttggggcctcgggggctactggggccagggaaccatggtcaccgtctcctcagcctccaccaagggcccatcggtcttcccctggcaccctcctccaagagcacctctgggggcacagcggccctgggctgcctggtcaaggactactcctgtcgagcgt

SEQ ID NO: 450890 - DNA, 504 bp, Homo sapiens
  misc_feature: HEFZJCU01EUGTD.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgttctgcaaatggacagcctgagagtcgaagacacggctgtgtattactgtgtgtctctgacgcctcggccgaccttggcttcg

SEQ ID NO: 450891 - DNA, 528 bp, Homo sapiens
  misc_feature: HEFZJCU01BU3GK.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccactcggtcttcccctggcaccctcctccaagagcacctctgggggcacagcggcctgggctgcctggtcaaggactacttccg

SEQ ID NO: 450892 - DNA, 379 bp, Homo sapiens; identical to SEQ ID NO: 444450
  misc_feature: HEFZJCU01CDIDF.47.77.G11.1.454.heavy.3.raw

SEQ ID NO: 450893 - DNA, 529 bp, Homo sapiens
  misc_feature: HEFZJCU01A8EE3.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctcggcgccctcgctccaggagcacctccgagagcacagcggcccgtcgggcg

SEQ ID NO: 450894 - DNA, 406 bp, Homo sapiens
  misc_feature: HEFZJCU01CTIU0.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgattttggagtggttattatactccccgggatcttgactactgggccaggggaccctggtcaccgtctcctcagcttccaccaagggcccatcggtcttccccctggcgccctgctccaggagcacctctggggcacagcggccctgggctgcctggtcaaggactacttccgagtgcgtct

SEQ ID NO: 450895 - DNA, 523 bp, Homo sapiens
  misc_feature: HEFZJCU01CC0BW.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaatgaacagcctgagagccgatgacacggccgtgtattactgtgcgagagatggggcccacgaacgttactacgctatggacgtctggggccaagggaccac

SEQ ID NO: 450896 - DNA, 324 bp, Homo sapiens; identical to SEQ ID NO: 444475
  misc_feature: HEFZJCU01DKO3N.18.17.B06.1.454.heavy.3.raw

SEQ ID NO: 450897 - DNA, 392 bp, Homo sapiens; identical to SEQ ID NO: 444682
  misc_feature: HEFZJCU01DGLTZ.16.70.G04.1.454.heavy.3.raw

SEQ ID NO: 450898 - DNA, 520 bp, Homo sapiens
  misc_feature: HEFZJCU01D3VXB.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggtttcgtgtaggctattactaaaggtgtcagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggcccgattaaccatctccagagacgattccgagaacacggtgtatcttcaaatgaacaacctgagagccgacgacacggccgtttattactgtgcgagagattcgagtggttcggggacctcaccctggttctacttcgatctctgggcc

SEQ ID NO: 450899 - DNA, 504 bp, Homo sapiens
  misc_feature: HEFZJCU01E0WKP.22.11.A11.1.454.heavy.3.raw
acatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatacaaattccaagccgcgggggtcacccaatgtac

SEQ ID NO: 450900 - DNA, 523 bp, Homo sapiens
  misc_feature: HEFZJCU01DXWE8.12.40.D07.1.454.heavy.3.raw
atacgacgtacacgaccggtgctcgatttagtgatagagcgtaacaacagaggactcaccatggagtttgggctgagcgtggtttcgtcgttaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 450901 - DNA, 508 bp, Homo sapiens
  misc_feature: HEFZJCU01A3ZDS.48.34.D01.1.454.heavy.3.raw
agtatacatacacgaccggtgctcgatttagatcgtctgtgttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggtaccg

SEQ ID NO: 450902 - DNA, 488 bp, Homo sapiens
  misc_feature: HEFZJCU01CPB4H.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggccgccctgctccaggagcacctccgagagcacagcggccctgggctgcctggtcaaggactacttcctacgtgagct

SEQ ID NO: 450903 - DNA, 505 bp, Homo sapiens; identical to SEQ ID NO: 444759
  misc_feature: HEFZJCU01D8TDP.10.38.D05.1.454.heavy.3.raw

SEQ ID NO: 450904 - DNA, 512 bp, Homo sapiens
  misc_feature: HEFZJCU01ENSEG.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgtccttcggtccgcgggacttcgtgggggccagggaaccct

SEQ ID NO: 450905 - DNA, 491 bp, Homo sapiens; identical to SEQ ID NO: 444749
  misc_feature: HEFZJCU01A5QKC.11.13.B02.1.454.heavy.3.raw

SEQ ID NO: 450906 - DNA, 384 bp, Homo sapiens
  misc_feature: HEFZJCU01C36Y5.11.61.F06.1.454.heavy.3.raw
cgagagataccacgaccggtgctcgatttagctacgctctaagggaaaggggccggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 450907 - DNA, 487 bp, Homo sapiens
  misc_feature: HEFZJCU01ECW00.40.17.B06.1.454.heavy.3.raw
tctagcgactcacgaccggtgctcgatttagtcgatagtgaagggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgcagttttgtggaaagtcgaataaccatcaatgcagacacatccaagaaccagttctccctgcacctaaactctatgactcccgaggacgcggctgtttattactgtgcaagaggacgaattgcatactat

SEQ ID NO: 450908 - DNA, 520 bp, Homo sapiens
  misc_feature: HEFZJCU01AXWSQ.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccaggcgggagttccaagtactcctttgacgtctc

SEQ ID NO: 450909 - DNA, 497 bp, Homo sapiens
  misc_feature: HEFZJCU01CKBCZ.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccggaacacggtctatctgcacctgaccagcctgagaactgacgacacgtctctctactactgtgcgagagagttgacgagtcattgg

SEQ ID NO: 450910 - DNA, 502 bp, Homo sapiens
  misc_feature: HEFZJCU01CK59V.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaattgcaaacgatgcttttgatatgtggggccaagggacacg

SEQ ID NO: 450911 - DNA, 501 bp, Homo sapiens
  misc_feature: HEFZJCU01BNH2J.11.41.D08.1.454.heavy.3.raw
cgagagataccacgaccggtgctcgatttagtcacgcgagaaagggaaagggtctccgaagccttcggagaccctgtccctcacctgcactgtctctggtgactccatcagtaggtactattggagctggatccggcagcccccagggaagggactggagtggattgggtggatgtattacagtgggagcaccaactacaacccctccctcaagagtcgagtcaccatatcagtagacatgtccaagaaccagtgctccctgaagctgagctctgtgaccgctgcggacacggccgtgtattactgcgcgaaagggggatatagtggctacaatcggccctactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 450912 - DNA, 498 bp, Homo sapiens
  misc_feature: HEFZJCU01DXJIT.52.2.A02.1.454.heavy.3.raw
cgcagtacgacacgaccggtgctcgatttagactcatctacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaggtggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaaatatactatgtagactccgtgaagggccgattcatcatctccagagacaattccgagaacaccctgtatctgcaaatgaacagcctgagagctgaggacacggctgtgtattactgtgcgaacttatcacgggaggacaggtcgccccgtcg

SEQ ID NO: 450913 - DNA, 501 bp, Homo sapiens; identical to SEQ ID NO: 445341
  misc_feature: HEFZJCU01DAQRJ.48.34.D01.1.454.heavy.3.raw

SEQ ID NO: 450914 - DNA, 512 bp, Homo sapiens
  misc_feature: HEFZJCU01EQ9E0.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 450915 - DNA, 493 bp, Homo sapiens
  misc_feature: HEFZJCU01C20L2.51.48.E04.1.454.heavy.3.raw
cgatcgtatacacgaccggtgctcgatttagagagcgtcacagagagaaggggtctgggagaggagcccagcactagaagtcggcggtgtttccattcggtgatcagcactgaacacagaggactcaccatggagtttgggctgagctgggttttcctcgctgctcttataagaggtgtccagtgtcaggtacaactggtggagtctgggggaggcgtggtccagcctgggaggtccctgagactctcctgtgcagcctctggattcactttcagaacttatgggatccactgggtccgccaggctccaggcaaggggctggagtgggtgtcacttatatcatatgatggaagaaacaaacattatgcagactccgtgcagggccgattcacaatctccagagacaattccaagaacacggtgttttgcaaatgaacagcctgagaggtgaggacacggctgtctattactgtgcgaaggagaagtattttca

SEQ ID NO: 450916 - DNA, 511 bp, Homo sapiens; identical to SEQ ID NO: 445840
  misc_feature: HEFZJCU01DO4HM.11.13.B02.1.454.heavy.3.raw

SEQ ID NO: 450917 - DNA, 499 bp, Homo sapiens; identical to SEQ ID NO: 446805
  misc_feature: HEFZJCU01AY5AK.3.20.B09.1.454.heavy.3.raw

SEQ ID NO: 450918 - DNA, 521 bp, Homo sapiens
  misc_feature: HEFZJCU01BL83X.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattagtccctactttgactactggggccagggaactctggtcaccgtctccgcagcctccaccaagggcccatcggtcttccccctggcaccctcctccaagagcacctctgggggcacagcgcctgggctgcctggtc

SEQ ID NO: 450919 - DNA, 390 bp, Homo sapiens
  misc_feature: HEFZJCU01C9FCW.48.42.D09.1.454.heavy.3.raw
agtatacatacacgaccggtgctcgatttagacacatacgcagggaaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 450920 - DNA, 504 bp, Homo sapiens
  misc_feature: HEFZJCU01EN8JA.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcaggggtcaccatgaccacggacacgtccataagcacagtttacatggaggtaaataggctgagatctgacgacacggccgtatattactgtgcgttattaacggacgattacgatgttttgattggtttttacg

SEQ ID NO: 450921 - DNA, 390 bp, Homo sapiens; identical to SEQ ID NO: 447143
  misc_feature: HEFZJCU01DNJOQ.48.70.G04.1.454.heavy.3.raw

SEQ ID NO: 450922 - DNA, 501 bp, Homo sapiens
  misc_feature: HEFZJCU01AFEBJ.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggtcttttgatgcctttgatatgtgggccagggacaatggtcaccgt

SEQ ID NO: 450923 - DNA, 524 bp, Homo sapiens
  misc_feature: HEFZJCU01AU9Z2.3.82.H05.1.454.heavy.3.raw
agacgcactccacgaccggtgctcgatttagtcgagctctctcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggacctcaccctggttctacttcgatctctggggccgt

SEQ ID NO: 450924 - DNA, 422 bp, Homo sapiens
  misc_feature: HEFZJCU01E2ABE.26.86.H09.1.454.heavy.3.raw
agactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagtatagtct

SEQ ID NO: 450925 - DNA, 403 bp, Homo sapiens; identical to SEQ ID NO: 445456
  misc_feature: HEFZJCU01DA3LI.3.72.G06.1.454.heavy.3.raw

SEQ ID NO: 450926 - DNA, 529 bp, Homo sapiens; identical to SEQ ID NO: 446480
  misc_feature: HEFZJCU01EE7G6.18.33.C11.1.454.heavy.3.raw

SEQ ID NO: 450927 - DNA, 491 bp, Homo sapiens; identical to SEQ ID NO: 447491
  misc_feature: HEFZJCU01DCUZ5.4.57.F02.1.454.heavy.3.raw

SEQ ID NO: 450928 - DNA, 352 bp, Homo sapiens
  misc_feature: HEFZJCU01B2B1M.22.86.H09.1.454.heavy.3.raw
acatacgcgtcacgaccggtgctcgatttagtgctatagacttgggtttgggctgagcgtggtttcgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacag

SEQ ID NO: 450929 - DNA, 400 bp, Homo sapiens; identical to SEQ ID NO: 444452
  misc_feature: HEFZJCU01DQB8C.47.24.C02.1.454.heavy.3.raw

SEQ ID NO: 450930 - DNA, 499 bp, Homo sapiens
  misc_feature: HEFZJCU01EPKHD.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgcctgctccagagcacctctggggcacagcggcctggctgcctgtcagactactccata

SEQ ID NO: 450931 - DNA, 518 bp, Homo sapiens; identical to SEQ ID NO: 445810
  misc_feature: HEFZJCU01C2QYG.2.11.A11.1.454.heavy.3.raw

SEQ ID NO: 450932 - DNA, 502 bp, Homo sapiens
  misc_feature: HEFZJCU01E05HV.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgta

SEQ ID NO: 450933 - DNA, 502 bp, Homo sapiens
  misc_feature: HEFZJCU01CZLQA.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccaccgcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgttattactgtgcgaaagatttctatagaggtgacgtac

SEQ ID NO: 450934 - DNA, 500 bp, Homo sapiens; identical to SEQ ID NO: 450218
  misc_feature: HEFZJCU01BSWRK.17.10.A10.1.454.heavy.3.raw

SEQ ID NO: 450935 - DNA, 372 bp, Homo sapiens
  misc_feature: HEFZJCU01E1HS7.3.42.D09.1.454.heavy.3.raw
agacgcactccacgaccggtgctcgatttagacacatacgcagggaaggggctggagtggattgggagtttctattatgggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 450936 - DNA, 396 bp, Homo sapiens; identical to SEQ ID NO: 445898
  misc_feature: HEFZJCU01BM91F.10.42.D09.1.454.heavy.3.raw

SEQ ID NO: 450937 - DNA, 484 bp, Homo sapiens; identical to SEQ ID NO: 446564
  misc_feature: HEFZJCU01EDFTR.19.13.B02.1.454.heavy.3.raw

SEQ ID NO: 450938 - DNA, 382 bp, Homo sapiens
  misc_feature: HEFZJCU01AQMTC.9.80.H03.1.454.heavy.3.raw
tgatacgtctcacgaccggtgctcgatttagctgtgcgtcgaagggaaaggggctggtgtgggtcgcacgtattaatgaagacgggactactataaattacgcggactccgtgaagggccgattcaccatctccagagacgacgccaagaacacgctgtatctgcaaatgaacagtctgagagtcgaggacacggctgtatattactgcgcaaaggattgtttcggggagactgactcctggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 450939 - DNA, 494 bp, Homo sapiens
  misc_feature: HEFZJCU01ARN8E.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccccctccagagcacctctgggggcacagcggccctgggctgcctggtcaggactacttccgagtagtaca

SEQ ID NO: 450940 - DNA, 485 bp, Homo sapiens
  misc_feature: HEFZJCU01CDV6C.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgcctgctccaggagcacctccgagagcacagcggccctgggctgcctggtcaaggactacttcctacgtgagct

SEQ ID NO: 450941 - DNA, 504 bp, Homo sapiens
  misc_feature: HEFZJCU01BKEQW.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaaggcccatcggtcttccccctgcg

SEQ ID NO: 450942 - DNA, 469 bp, Homo sapiens; identical to SEQ ID NO: 447626
  misc_feature: HEFZJCU01AQGJ0.15.34.D01.1.454.heavy.3.raw

SEQ ID NO: 450943 - DNA, 510 bp, Homo sapiens; identical to SEQ ID NO: 449925
  misc_feature: HEFZJCU01CAMJ3.17.25.C03.1.454.heavy.3.raw

SEQ ID NO: 450944 - DNA, 538 bp, Homo sapiens
  misc_feature: HEFZJCU01AS3V6.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcattttttagcgaatatgccatgagctgggtccaccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaagggcccatcggtcttcccctggcaccctcctccaagagcacctctgggggcacagcc

SEQ ID NO: 450945 - DNA, 480 bp, Homo sapiens; identical to SEQ ID NO: 444947
  misc_feature: HEFZJCU01CC8VE.22.36.D03.1.454.heavy.3.raw

SEQ ID NO: 450946 - DNA, 524 bp, Homo sapiens
  misc_feature: HEFZJCU01CD56P.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccaggggaccctggtcatcgtctccccagcctccaccaagggcccatcggtcttccccctggccg

SEQ ID NO: 450947 - DNA, 516 bp, Homo sapiens; identical to SEQ ID NO: 445437
  misc_feature: HEFZJCU01C9YDG.26.71.G05.1.454.heavy.3.raw

SEQ ID NO: 450948 - DNA, 497 bp, Homo sapiens
  misc_feature: HEFZJCU01DXU9J.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggactttcg

SEQ ID NO: 450949 - DNA, 520 bp, Homo sapiens
  misc_feature: HEFZJCU01BHZ8Y.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctggggccagggaacccttgtcaccgtctcctcagcctccaccaacgggcccacg

SEQ ID NO: 450950 - DNA, 514 bp, Homo sapiens; identical to SEQ ID NO: 449003
  misc_feature: HEFZJCU01BDUJH.4.57.F02.1.454.heavy.3.raw

SEQ ID NO: 450951 - DNA, 484 bp, Homo sapiens
  misc_feature: HEFZJCU01D81TW.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctcggcgccctgctccaggagcacctccgagagcacagcggccctgggctgcctggtcaaggactacttcccactactatg

SEQ ID NO: 450952 - DNA, 404 bp, Homo sapiens
  misc_feature: HEFZJCU01E01ST.14.60.F05.1.454.heavy.3.raw
cgtctagtaccacgaccggtgctcgatttagtacgtcatcagggaaagggctggagtgggttggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgacccctggggccagggaaccctggtcaccgtctcctcagcttccaccaagggcccatcggtcttccccctggcgccctgctccaggagcacctctgggggcacagcggccctgggctgcctggtcaaggactacttccgtactacgacg

SEQ ID NO: 450953 - DNA, 513 bp, Homo sapiens
  misc_feature: HEFZJCU01CKDX3.3.34.D01.1.454.heavy.3.raw
agacgcactccacgaccggtgctcgatttagatcgtctgtgttgggtttggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggcccaaggggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 450954 - DNA, 502 bp, Homo sapiens
  misc_feature: HEFZJCU01CM0LW.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccactgggggccaac

SEQ ID NO: 450955 - DNA, 504 bp, Homo sapiens
  misc_feature: HEFZJCU01EXWA3.14.55.E11.1.454.heavy.3.raw
cgtctagtaccacgaccggtgctcgatttagcactcgcacgttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaaagactaccaaccccttacgta

SEQ ID NO: 450956 - DNA, 481 bp, Homo sapiens
  misc_feature: HEFZJCU01B0J6U.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 450957 - DNA, 484 bp, Homo sapiens
  misc_feature: HEFZJCU01DU0FL.49.78.H01.1.454.heavy.3.raw
agtcgagagacacgaccggtgctcgatttagtgtgagtagtttgggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgtaaa

SEQ ID NO: 450958 - DNA, 465 bp, Homo sapiens
  misc_feature: HEFZJCU01B7LLJ.19.10.A10.1.454.heavy.3.raw
tactctcgtgcacgaccggtgctcgatttagcgtcgatctcaggggtccctgagactctcctgtagaagttatggattcaacttcgctagtggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 450959 - DNA, 499 bp, Homo sapiens
  misc_feature: HEFZJCU01B5WL4.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggt

SEQ ID NO: 450960 - DNA, 507 bp, Homo sapiens
  misc_feature: HEFZJCU01BE0VL.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtggggcccacgaacgttactacgctatggacgtcgt

SEQ ID NO: 450961 - DNA, 506 bp, Homo sapiens
  misc_feature: HEFZJCU01D96H0.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcacgtctcttcagcctccaccaagggcccatcggtccttcccctggccgcctgctccaggacg

SEQ ID NO: 450962 - DNA, 517 bp, Homo sapiens; identical to SEQ ID NO: 445684
  misc_feature: HEFZJCU01ETSW4.9.34.D01.1.454.heavy.3.raw

SEQ ID NO: 450963 - DNA, 507 bp, Homo sapiens
  misc_feature: HEFZJCU01CK5CB.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccagcaagggcccatcggtcttcccctggcgccctcgctccaggagcgacctccgagagcacagcggcccg

SEQ ID NO: 450964 - DNA, 366 bp, Homo sapiens
  misc_feature: HEFZJCU01BFGYU.14.46.E02.1.454.heavy.3.raw
cgtctagtaccacgaccggtgctcgatttagactcatctacaggggaaagggactggagtggattgggcttatcaatgccagtggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttccccctggcgccctgctccaggagcacctccgagagcacagcggccctgggctgcctggtcaaggactacttccgtactagacg

SEQ ID NO: 450965 - DNA, 498 bp, Homo sapiens
  misc_feature: HEFZJCU01DH25V.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggaccacggctgtgtattactgtgtcagagatgggagggggtggtgatccga

SEQ ID NO: 450966 - DNA, 513 bp, Homo sapiens; identical to SEQ ID NO: 446452
  misc_feature: HEFZJCU01BAQK3.17.33.C11.1.454.heavy.3.raw

SEQ ID NO: 450967 - DNA, 492 bp, Homo sapiens
  misc_feature: HEFZJCU01EXNRU.11.38.D05.1.454.heavy.3.raw
cgagagataccacgaccggtgctcgatttagtatctgatagttgggtctgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 450968 - DNA, 521 bp, Homo sapiens
  misc_feature: HEFZJCU01ERH06.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttagttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctgggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattc

SEQ ID NO: 450969 - DNA, 518 bp, Homo sapiens
  misc_feature: HEFZJCU01DDVSH.53.27.C05.1.454.heavy.3.raw
cgcgtatacacacgaccggtgctcgatttagacgcgatcgaagggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgatgtctggggaccg

SEQ ID NO: 450970 - DNA, 533 bp, Homo sapiens
  misc_feature: HEFZJCU01AF3T8.17.28.C06.1.454.heavy.3.raw
cgtagactagcacgaccggtgctcgatttagagctcacgtattgggtttggggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccgtctcctcagcct

SEQ ID NO: 450971 - DNA, 512 bp, Homo sapiens; identical to SEQ ID NO: 447906
  misc_feature: HEFZJCU01EE6WL.17.33.C11.1.454.heavy.3.raw

SEQ ID NO: 450972 - DNA, 520 bp, Homo sapiens; identical to SEQ ID NO: 446725
  misc_feature: HEFZJCU01AYGZJ.12.86.H09.1.454.heavy.3.raw

SEQ ID NO: 450973 - DNA, 518 bp, Homo sapiens
  misc_feature: HEFZJCU01AQ2J2.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggccaccctcctccaagagcacctcgtggggcacgagcggtcccg

SEQ ID NO: 450974 - DNA, 517 bp, Homo sapiens
  misc_feature: HEFZJCU01EK9JH.4.25.C03.1.454.heavy.3.raw
agcactgtagcacgaccggtgctcgatttagtagtgtagatttgggtttgggctgagcgtggttttcgtcgttaggctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttaccctctggttccttcgacagttatggtatggacgtctgggccgtagggactacggtcaccgtctcctcagcctccaccaacgggcccactcggtcttcccctcggca

SEQ ID NO: 450975 - DNA, 356 bp, Homo sapiens; identical to SEQ ID NO: 444460
  misc_feature: HEFZJCU01D8UAK.47.38.D05.1.454.heavy.3.raw

SEQ ID NO: 450976 - DNA, 530 bp, Homo sapiens
  misc_feature: HEFZJCU01B3DSD.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatccggtcttccccctggccgcccgtcg

SEQ ID NO: 450977 - DNA, 502 bp, Homo sapiens; identical to SEQ ID NO: 445414
  misc_feature: HEFZJCU01E03G4.17.25.C03.1.454.heavy.3.raw

SEQ ID NO: 450978 - DNA, 387 bp, Homo sapiens
  misc_feature: HEFZJCU01AYFGE.52.34.D01.1.454.heavy.3.raw
cgcagtacgacacgaccggtgctcgatttagatcgtctgtgctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctggggcacagtggccctgggctgcctggtcaaggactacttcctatacgatcg

SEQ ID NO: 450979 - DNA, 508 bp, Homo sapiens; identical to SEQ ID NO: 445594
  misc_feature: HEFZJCU01EKNRG.17.25.C03.1.454.heavy.3.raw

SEQ ID NO: 450980 - DNA, 507 bp, Homo sapiens; identical to SEQ ID NO: 445401
  misc_feature: HEFZJCU01BOFCY.22.86.H09.1.454.heavy.3.raw

SEQ ID NO: 450981 - DNA, 534 bp, Homo sapiens
  misc_feature: HEFZJCU01EH0HD.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattccaccatctcagaagacaattccaggaacacattgtatcttcaaatgaataacctgagagccgaggacacggccatgtattactgtgtggggcatttacttgacccgtggggccggggaacccgtggtcaccgtcctccccaccctccaacccg

SEQ ID NO: 450982 - DNA, 511 bp, Homo sapiens; identical to SEQ ID NO: 446799
  misc_feature: HEFZJCU01DML10.18.39.D06.1.454.heavy.3.raw

SEQ ID NO: 450983 - DNA, 520 bp, Homo sapiens; identical to SEQ ID NO: 450321
  misc_feature: HEFZJCU01CKG6T.9.34.D01.1.454.heavy.3.raw

SEQ ID NO: 450984 - DNA, 513 bp, Homo sapiens
  misc_feature: HEFZJCU01DGVCY.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggccatcggtcttcccctggccta

SEQ ID NO: 450985 - DNA, 524 bp, Homo sapiens; identical to SEQ ID NO: 445902
  misc_feature: HEFZJCU01COJ7W.9.78.H01.1.454.heavy.3.raw

SEQ ID NO: 450986 - DNA, 519 bp, Homo sapiens
  misc_feature: HEFZJCU01B9740.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattacc

SEQ ID NO: 450987 - DNA, 316 bp, Homo sapiens; identical to SEQ ID NO: 444444
  misc_feature: HEFZJCU01C7EKG.47.56.F01.1.454.heavy.3.raw

SEQ ID NO: 450988 - DNA, 511 bp, Homo sapiens
  misc_feature: HEFZJCU01ET8WT.49.27.C05.1.454.heavy.3.raw
agtcgagagacacgaccggtgctcgatttagacgcgatcgaagggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaaatattcacaaaagttccagggcagagtcaccatttacagggacacatctgcgagttcaggctacatggaactgagcggcctgagatatgaggacacggctatttattactgtgcgagagggaaatgggatattgtgtcagctccaggtgcccagccggcccctactttgactacg

SEQ ID NO: 450989 - DNA, 508 bp, Homo sapiens
  misc_feature: HEFZJCU01DY7YT.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattactgtgcgaaagacacagccgcatttgggggagtcatcgt

SEQ ID NO: 450990 - DNA, 548 bp, Homo sapiens
  misc_feature: HEFZJCU01ES8BD.21.46.E02.1.454.heavy.3.raw
tcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaaccctggtaaccgtctcctcagcctccaccaagggcccatcggtccttcccctggcgccctgcctccaggagcacctccgagagcacagcggccctgggctgcctggtcaaggactacttcccga

SEQ ID NO: 450991 - DNA, 513 bp, Homo sapiens; identical to SEQ ID NO: 446699
  misc_feature: HEFZJCU01DB33R.12.25.C03.1.454.heavy.3.raw

SEQ ID NO: 450992 - DNA, 472 bp, Homo sapiens
  misc_feature: HEFZJCU01ECKZ7.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactggggggcctgtcgtggtggttggtgccgcaatgatgcatttcatatttggggccaagggacagtggtcaccgtctcggcagcctccaccaagggcccatcggtcttccccctggcgccctgctccaggagcacctccgagagcacagcggccctgggctgcctggtcaaggactacttccagacgtatca

SEQ ID NO: 450993 - DNA, 497 bp, Homo sapiens
  misc_feature: HEFZJCU01B99GE.47.56.F01.1.454.heavy.3.raw
agctcacgtacacgaccggtgctcgatttagcagacgtctgaacacacaaaggggcccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgactttatttc

SEQ ID NO: 450994 - DNA, 378 bp, Homo sapiens; identical to SEQ ID NO: 444419
  misc_feature: HEFZJCU01BQMJ3.47.77.G11.1.454.heavy.3.raw

SEQ ID NO: 450995 - DNA, 499 bp, Homo sapiens
  misc_feature: HEFZJCU01CRL1B.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcacctggtcactgtctcctcggcttccaccaagggcccatcggtcttcccctgcgcctgctcagagcacctctggggcac

SEQ ID NO: 450996 - DNA, 510 bp, Homo sapiens
  misc_feature: HEFZJCU01B9XKR.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtctttgactactggggcctgggactctggtcacgtct

SEQ ID NO: 450997 - DNA, 513 bp, Homo sapiens
  misc_feature: HEFZJCU01B5DRZ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctattttaaaaggtgccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactcgctatggacgtctggggccagggaccg

SEQ ID NO: 450998 - DNA, 521 bp, Homo sapiens
  misc_feature: HEFZJCU01C4EVZ.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctggactgaactgggttttcctcgttgctcttttaagaggtgtccagtgtcaagtgcaactggtggagtctgggggaggcgtagtccagcctgggaggtcacagtagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccg

SEQ ID NO: 450999 - DNA, 521 bp, Homo sapiens
  misc_feature: HEFZJCU01B029D.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctggggacacacg

SEQ ID NO: 451000 - DNA, 418 bp, Homo sapiens; identical to SEQ ID NO: 446028
  misc_feature: HEFZJCU01DNQP6.16.28.C06.1.454.heavy.3.raw

SEQ ID NO: 451001 - DNA, 526 bp, Homo sapiens
  misc_feature: HEFZJCU01AU04Z.48.56.F01.1.454.heavy.3.raw
agtatacatacacgaccggtgctcgatttagcagacgtctgaacacacaaaggggtctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaatcaagtgggctcatctcgggcggccgacccacgtggggccg

SEQ ID NO: 451002 - DNA, 512 bp, Homo sapiens
  misc_feature: HEFZJCU01CS4BK.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaatttttggactcgtcattctccctttgacttctggggccagggaaccctagtcaccgt

SEQ ID NO: 451003 - DNA, 526 bp, Homo sapiens; identical to SEQ ID NO: 448857
  misc_feature: HEFZJCU01CIVCK.7.70.G04.1.454.heavy.3.raw

SEQ ID NO: 451004 - DNA, 534 bp, Homo sapiens
  misc_feature: HEFZJCU01DCD4S.52.78.H01.1.454.heavy.3.raw
cgcagtacgacacgaccggtgctcgatttagtgtgagtagtttgggtttggggggacctcctgtgcaagaacatgaagcacctgtggttcttcctcctgctggtggcggctcccagatgggtcctgtcccagctgcagctgcaagagtcgggcccacgactggtgaagcctgcggagcccctgtccctcacctgcactgtctctggtgactccatcaccaataatgattactactgggcctggatccgccagcccccagggaaggggctggagtggattggcagtatattttatactggaaatacctaccaaaacccgtccctcaacagccgactcaccatttcagtggacacgtccaagaaccagttctccctgaaactgagctctgtgaccgccgcagacacggccatttattactgtgcgggagagaggcacaagactggagttcccgggagctggttcggctcctggggccaggggaccccggtcaccgtctcctcagcctccaccaagggcccatcggtcttcccctgg

SEQ ID NO: 451005 - DNA, 483 bp, Homo sapiens; identical to SEQ ID NO: 444932
  misc_feature: HEFZJCU01AGA85.7.10.A10.1.454.heavy.3.raw

SEQ ID NO: 451006 - DNA, 506 bp, Homo sapiens; identical to SEQ ID NO: 444732
  misc_feature: HEFZJCU01CHD00.14.78.H01.1.454.heavy.3.raw

SEQ ID NO: 451007 - DNA, 499 bp, Homo sapiens
  misc_feature: HEFZJCU01BS6O8.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcaccctatatttgatgtagcagactctgcacagaagttccagggcagaataacaattacggcggacaaatccacgaccacagcctacatggagctgagcagcctgagatctgaggacacggcccttttattactgtgcgagatttaccgtgggggtcacggcggatatatcgcatta

SEQ ID NO: 451008 - DNA, 337 bp, Homo sapiens; identical to SEQ ID NO: 446010
  misc_feature: HEFZJCU01CNA6J.51.30.C08.1.454.heavy.3.raw

SEQ ID NO: 451009 - DNA, 511 bp, Homo sapiens; identical to SEQ ID NO: 448238
  misc_feature: HEFZJCU01D4ATI.15.67.G01.1.454.heavy.3.raw

SEQ ID NO: 451010 - DNA, 492 bp, Homo sapiens
  misc_feature: HEFZJCU01D87QM.48.20.B09.1.454.heavy.3.raw
agtatacatacacgaccggtgctcgatttagtgtagtgtgaaggggctccctcactgcccagctgggatctcagggcttcattttctgtcctccaccatcatggggtcaaccgccatcctcgccctcctcctggctgttctccaaggagtctgtgccgaggtgcagctggtgcagtctggagcacaattgaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaacggcctcggacaccgccgtgtattactgtgcgagacatgattacggctactcacgtcccgcactacgtgggccaac

SEQ ID NO: 451011 - DNA, 524 bp, Homo sapiens
  misc_feature: HEFZJCU01DH29T.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcgcgtatctgcagatcaccagccttcaggctgaggacactgccatttattactgtgcgagagagggggagagtggagtagaacgtaaatacgggaaaccgtttgacttttgggccagggaacctggtcaccgtctcctcagcctccaccaagggcccatcggtcttcccctggcaccctcctccaagagcacctctggggcacagcgcctggctgctc

SEQ ID NO: 451012 - DNA, 499 bp, Homo sapiens; identical to SEQ ID NO: 447763
  misc_feature: HEFZJCU01BCK3Q.3.20.B09.1.454.heavy.3.raw

SEQ ID NO: 451013 - DNA, 499 bp, Homo sapiens
  misc_feature: HEFZJCU01CX9PB.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtgaagagacgttggtggctaccgcggggctgaccactggggccg

SEQ ID NO: 451014 - DNA, 507 bp, Homo sapiens
  misc_feature: HEFZJCU01C4LDL.4.67.G01.1.454.heavy.3.raw
  modified_base (498)..(498): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgnggtccgggt

SEQ ID NO: 451015 - DNA, 324 bp, Homo sapiens; identical to SEQ ID NO: 444475
  misc_feature: HEFZJCU01BDMMH.18.17.B06.1.454.heavy.3.raw

SEQ ID NO: 451016 - DNA, 463 bp, Homo sapiens; identical to SEQ ID NO: 446208
  misc_feature: HEFZJCU01D078T.19.10.A10.1.454.heavy.3.raw

SEQ ID NO: 451017 - DNA, 497 bp, Homo sapiens
  misc_feature: HEFZJCU01BFE3H.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaattgcaacgatgcttttgatatgtggggccg

SEQ ID NO: 451018 - DNA, 312 bp, Homo sapiens; identical to SEQ ID NO: 444415
  misc_feature: HEFZJCU01EX8XZ.7.10.A10.1.454.heavy.3.raw

SEQ ID NO: 451019 - DNA, 523 bp, Homo sapiens
  misc_feature: HEFZJCU01D1NTB.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggaccgtcaccctggttctacttcgatctctggggcc

SEQ ID NO: 451020 - DNA, 479 bp, Homo sapiens
  misc_feature: HEFZJCU01CUIBB.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggcctggctgcctggtcaaggactacttcctagagacacg

SEQ ID NO: 451021 - DNA, 510 bp, Homo sapiens
  misc_feature: HEFZJCU01EKEM4.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgtaggctatttaaaaggtgccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccattcaccatctccagagacaattccaagaacacgctgttcttcaaatgaacagcctgagagccgatgaacacggccgtgtattactgtgcgagagatggggcccacgaacgttactacgctatggacgtctggggccg

SEQ ID NO: 451022 - DNA, 495 bp, Homo sapiens
  misc_feature: HEFZJCU01DMK7Q.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggcctgggctgcctggtcaaggactacttccgagtagtaca

SEQ ID NO: 451023 - DNA, 524 bp, Homo sapiens
  misc_feature: HEFZJCU01DR0IX.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactggggccagggaaccctggtcacgtctcctcagcctccaccaagggcccatcggtcttccccctcggcgccctgctcca

SEQ ID NO: 451024 - DNA, 391 bp, Homo sapiens; identical to SEQ ID NO: 447368
  misc_feature: HEFZJCU01EMUSW.13.77.G11.1.454.heavy.3.raw

SEQ ID NO: 451025 - DNA, 525 bp, Homo sapiens; identical to SEQ ID NO: 450208
  misc_feature: HEFZJCU01ESMKT.3.82.H05.1.454.heavy.3.raw

SEQ ID NO: 451026 - DNA, 506 bp, Homo sapiens
  misc_feature: HEFZJCU01CBRYM.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccggggggtccctgagactctcctgtgcagcctctggattcagttttagaatgtctgccatgacctgggtccgccaggctcctgggaagggctggagtggatctcagggattagtggcacgtggcgattatacatattatacagactccgtgaagggccgcttcaccatctccagagacaattccaagaacacggtgtatctgcaaatgaacagcctgagagccgaggacacggccacatattactgtgcgaaagatctcgggctggtccgcggtccgggt

SEQ ID NO: 451027 - DNA, 521 bp, Homo sapiens
  misc_feature: HEFZJCU01DCKKD.9.34.D01.1.454.heavy.3.raw
tgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggacgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctcccaagagcacctctgggggcacagcggccctgggctgcctggtcaaggactacttccagacgtatca

SEQ ID NO: 451028 - DNA, 396 bp, Homo sapiens; identical to SEQ ID NO: 444731
  misc_feature: HEFZJCU01EVJOJ.18.61.F06.1.454.heavy.3.raw

SEQ ID NO: 451029 - DNA, 467 bp, Homo sapiens; identical to SEQ ID NO: 445004
  misc_feature: HEFZJCU01DI76E.16.78.H01.1.454.heavy.3.raw

SEQ ID NO: 451030 - DNA, 530 bp, Homo sapiens
  misc_feature: HEFZJCU01DZ886.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccagggaaccctggtcaccgtctcctcagccctccaaccg

SEQ ID NO: 451031 - DNA, 501 bp, Homo sapiens
  misc_feature: HEFZJCU01D7XB1.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 451032 - DNA, 476 bp, Homo sapiens; identical to SEQ ID NO: 445154
  misc_feature: HEFZJCU01BJXTI.16.10.A10.1.454.heavy.3.raw

SEQ ID NO: 451033 - DNA, 397 bp, Homo sapiens
  misc_feature: HEFZJCU01CWXOR.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctgggtcaaggactacttcctacgtgagct

SEQ ID NO: 451034 - DNA, 467 bp, Homo sapiens; identical to SEQ ID NO: 445159
  misc_feature: HEFZJCU01E0PE7.48.7.A07.1.454.heavy.3.raw

SEQ ID NO: 451035 - DNA, 536 bp, Homo sapiens
  misc_feature: HEFZJCU01D97HU.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccccggcgccctgctccaggagcacctccgacgagcacagcggcccgtcgggcgtgcctggtccaaggactacttccagtaccg

SEQ ID NO: 451036 - DNA, 514 bp, Homo sapiens
  misc_feature: HEFZJCU01AYJEW.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctggaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggcctgggctgcctggtcaaggactacttcc

SEQ ID NO: 451037 - DNA, 521 bp, Homo sapiens
  misc_feature: HEFZJCU01EBP7Y.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagctggtcaccgtctcctcagcctcc

SEQ ID NO: 451038 - DNA, 532 bp, Homo sapiens
  misc_feature: HEFZJCU01DFEH3.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacgggtgactactgggggtttcggaccccgtggggccaggggaaccctggtcaccgtctcctcagcctccacccg

SEQ ID NO: 451039 - DNA, 509 bp, Homo sapiens
  misc_feature: HEFZJCU01DTLM4.19.3.A03.1.454.heavy.3.raw
tactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccagggaaggggctggagtgggtctcttccattaataaacatgccagtgacatgtactacgcagacgcactggagggccgattcaccatctccagagacaacgccaggagctcactgtttcttcacatgaacaacctcgaccccgaggatacagctatatattattgtgggagagaaagagtaggggggagtccgtcgtggcgagggaccc

SEQ ID NO: 451040 - DNA, 503 bp, Homo sapiens
  misc_feature: HEFZJCU01CQZPO.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggacttccgtactagacg

SEQ ID NO: 451041 - DNA, 520 bp, Homo sapiens
  misc_feature: HEFZJCU01E1PNU.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttccccctggcacccctcctccaagagcacctcgtgggggcacagcggccgtgggctgcctggtcaaggactacttccagacgtatca

SEQ ID NO: 451042 - DNA, 522 bp, Homo sapiens; identical to SEQ ID NO: 446788
  misc_feature: HEFZJCU01B81RZ.12.40.D07.1.454.heavy.3.raw

SEQ ID NO: 451043 - DNA, 537 bp, Homo sapiens
  misc_feature: HEFZJCU01AU0ZA.48.14.B03.1.454.heavy.3.raw
agtatacatacacgaccggtgctcgatttagtgtgagtagttccgcgggggtctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggaccggccgtcttcgggggccagggaacactggttatcgtctcttcacg

SEQ ID NO: 451044 - DNA, 521 bp, Homo sapiens
  misc_feature: HEFZJCU01B7BK3.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagccgcgggggtcacccaaattgactactgggccagggaaccctggtcaccgtctcctcagcctccaccaagggcccatcggtcttcccctcggcgccctgctcc

SEQ ID NO: 451045 - DNA, 514 bp, Homo sapiens
  misc_feature: HEFZJCU01CKX5O.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaacagcgggagtccaagtactcctttg

SEQ ID NO: 451046 - DNA, 523 bp, Homo sapiens
  misc_feature: HEFZJCU01CSEID.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccctggcg

SEQ ID NO: 451047 - DNA, 506 bp, Homo sapiens; identical to SEQ ID NO: 446520
  misc_feature: HEFZJCU01EGR4N.10.38.D05.1.454.heavy.3.raw

SEQ ID NO: 451048 - DNA, 487 bp, Homo sapiens; identical to SEQ ID NO: 445077
  misc_feature: HEFZJCU01CUFA8.47.85.H08.1.454.heavy.3.raw

SEQ ID NO: 451049 - DNA, 511 bp, Homo sapiens
  misc_feature: HEFZJCU01AY3DQ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctggggcacagcggccctgggctgcctggtcaaggactacttcccatacc

SEQ ID NO: 451050 - DNA, 524 bp, Homo sapiens; identical to SEQ ID NO: 446401
  misc_feature: HEFZJCU01ENS9P.3.82.H05.1.454.heavy.3.raw

SEQ ID NO: 451051 - DNA, 506 bp, Homo sapiens; identical to SEQ ID NO: 444696
  misc_feature: HEFZJCU01EDPZV.16.34.D01.1.454.heavy.3.raw

SEQ ID NO: 451052 - DNA, 456 bp, Homo sapiens
  misc_feature: HEFZJCU01DSVX5.49.82.H05.1.454.heavy.3.raw
agtcgagagacacgaccggtgctcgatttagtcgagctctctcgcgggcacgaccggtgctcgatttagtcgagctctctcgcgggcacgaccggtgctcgatttagcacacgatagttgggtttggggtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaaggcccatcggtcttcccctggcaccctcctccaagagcacctctgggggcacagcggccctgggctgcctggtcaaggactacttcctctctcgact

SEQ ID NO: 451053 - DNA, 508 bp, Homo sapiens; identical to SEQ ID NO: 445288
  misc_feature: HEFZJCU01AEFOW.51.43.D10.1.454.heavy.3.raw

SEQ ID NO: 451054 - DNA, 511 bp, Homo sapiens
  misc_feature: HEFZJCU01DM0JW.52.34.D01.1.454.heavy.3.raw
cgcagtacgacacgaccggtgctcgatttagatcgtctgtgcaactgttggagtctggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagtacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaggactacttcctatacgatcg

SEQ ID NO: 451055 - DNA, 515 bp, Homo sapiens; identical to SEQ ID NO: 446186
  misc_feature: HEFZJCU01BBS4F.9.70.G04.1.454.heavy.3.raw

SEQ ID NO: 451056 - DNA, 486 bp, Homo sapiens
  misc_feature: HEFZJCU01CPDOM.52.19.B08.1.454.heavy.3.raw
  modified_base (459)..(459): a, c, t, g, unknown or other
cgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttanatttactgtgcgtaacttaatcacgga

SEQ ID NO: 451057 - DNA, 399 bp, Homo sapiens; identical to SEQ ID NO: 445625
  misc_feature: HEFZJCU01DMQWX.53.42.D09.1.454.heavy.3.raw

SEQ ID NO: 451058 - DNA, 511 bp, Homo sapiens
  misc_feature: HEFZJCU01CV73E.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccagagcacctccgagagcacagcggccctcggg

SEQ ID NO: 451059 - DNA, 540 bp, Homo sapiens
  misc_feature: HEFZJCU01EJ908.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaacgggcccatcggtcttcccctcggcaccctcctccaagagcacctctgggggcacagcggccctgggctgcctggtacg

SEQ ID NO: 451060 - DNA, 506 bp, Homo sapiens
  misc_feature: HEFZJCU01D6O86.11.67.G01.1.454.heavy.3.raw
cgagagataccacgaccggtgctcgatttagagtatacatattgggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttcccctggcaccctcctccaagagcacctctgggggcacagcggccctgggctgcctggtcaaggactacc

SEQ ID NO: 451061 - DNA, 496 bp, Homo sapiens
  misc_feature: HEFZJCU01CMU8W.49.55.E11.1.454.heavy.3.raw
agtcgagagacacgaccggtgctcgatttagcactcgcacgttgggtttggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcacagtctctggtggctccatcagcaatgatggtcactactggagctggatccgccagctcccagggaagggcctggagtggattggggacatctctaacaatgggggcacccactacaacccgtccctgaagagtcgagttaccatatcagtagacaagtcgaagaagcaattctccctgaagctgaactctgtgactgccgcggacacggccgtgtattactgtgcgagagacctcgcggattactatgatagaagtggttactgggggcggtgtttatgat

SEQ ID NO: 451062 - DNA, 505 bp, Homo sapiens
  misc_feature: HEFZJCU01BCCAL.22.11.A11.1.454.heavy.3.raw
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaatgaacagcctgagagccgatgacacggccgtgtattactgtgtgagatcaaattccaagccgcgggggtcaccaaattgactactc

SEQ ID NO: 451063 - DNA, 524 bp, Homo sapiens
  misc_feature: HEFZJCU01BR07V.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtcttcccctggcaccctcctccaagagcacctctgggggcacagcggccctgggctgcctc

SEQ ID NO: 451064 - DNA, 522 bp, Homo sapiens
  misc_feature: HEFZJCU01BJ4O9.48.56.F01.1.454.heavy.3.raw
agtatacatacacgaccggtgctcgatttagcagacgtctgaacacacaaagggggctctgagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaaatcaagtgggctcatctcgggcggccgacccactc

SEQ ID NO: 451065 - DNA, 542 bp, Homo sapiens
  misc_feature: HEFZJCU01AK96I.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccagggaccgtggtcaccgtctcctcagcctccaccg

SEQ ID NO: 451066 - DNA, 514 bp, Homo sapiens
  misc_feature: HEFZJCU01BD2KA.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggaccg

SEQ ID NO: 451067 - DNA, 379 bp, Homo sapiens
  misc_feature: HEFZJCU01E0VYL.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccccggcgccctgctccaggagcacctctgggggcacagcggccctgggctgcctggtcaaggactacttcctacgtgagct

SEQ ID NO: 451068 - DNA, 400 bp, Homo sapiens; identical to SEQ ID NO: 444452
  misc_feature: HEFZJCU01EQDZG.47.24.C02.1.454.heavy.3.raw

SEQ ID NO: 451069 - DNA, 506 bp, Homo sapiens; identical to SEQ ID NO: 445682
  misc_feature: HEFZJCU01BD8RQ.48.44.D11.1.454.heavy.3.raw

SEQ ID NO: 451070 - DNA, 519 bp, Homo sapiens
  misc_feature: HEFZJCU01C4EWA.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgaccctggggccagggaacccttgtcaccgtctcctcagcctccaccaagggccctacg

SEQ ID NO: 451071 - DNA, 526 bp, Homo sapiens; identical to SEQ ID NO: 448857
  misc_feature: HEFZJCU01A6V9O.7.70.G04.1.454.heavy.3.raw

SEQ ID NO: 451072 - DNA, 410 bp, Homo sapiens; identical to SEQ ID NO: 445199
  misc_feature: HEFZJCU01A9ASL.9.11.A11.1.454.heavy.3.raw

SEQ ID NO: 451073 - DNA, 518 bp, Homo sapiens
  misc_feature: HEFZJCU01CXTLO.49.34.D01.1.454.heavy.3.raw
agtcgagagacacgaccggtgctcgatttagatcgtctgtgttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggcaccctcctccaagagcacctctgggggcacagcggccctgggctgcctggtcaaggactacttcctctctcgact

SEQ ID NO: 451074 - DNA, 496 bp, Homo sapiens
  misc_feature: HEFZJCU01DNPG9.4.87.H10.1.454.heavy.3.raw
agcactgtagcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaggaagcctggggcctcagtgaaggtctcctgcaagacttctggatacaccttcgccggctactatatgcactggattcgacaggcccctggacaagggcttgagtggatggggtggatcaacccttacagtggtgtcacaaactatgcacagaagtttcagggctgggtcaccgtgaccagggacacgtccgtcagcacagtttacatggaactgaggaaactgagatctgacgacacggccgtctactactgtgcgagagggtacacggttataccatctgcgctagta

SEQ ID NO: 451075 - DNA, 518 bp, Homo sapiens
  misc_feature: HEFZJCU01CHTX5.48.37.D04.1.454.heavy.3.raw
agtatacatacacgaccggtgctcgatttagtagcatactgttgggtttgggatctacggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 451076 - DNA, 316 bp, Homo sapiens; identical to SEQ ID NO: 444446
  misc_feature: HEFZJCU01AY78F.13.66.F11.1.454.heavy.3.raw

SEQ ID NO: 451077 - DNA, 379 bp, Homo sapiens; identical to SEQ ID NO: 444450
  misc_feature: HEFZJCU01CJUH6.47.77.G11.1.454.heavy.3.raw

SEQ ID NO: 451078 - DNA, 399 bp, Homo sapiens
  misc_feature: HEFZJCU01BMO66.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctgggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 451079 - DNA, 526 bp, Homo sapiens
  misc_feature: HEFZJCU01DQ452.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccggacgacacggctgtctattattgcgcgagagagacacacgaacctactggccaatactatgggggcttgttctggggccaggggccctggtcatcgtctcccagcctccaccaacgggcccatcggtcttcccctggccgccctg

SEQ ID NO: 451080 - DNA, 493 bp, Homo sapiens
  misc_feature: HEFZJCU01EZHB8.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccaagggacaat

SEQ ID NO: 451081 - DNA, 519 bp, Homo sapiens
  misc_feature: HEFZJCU01DY4VF.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaaggggaccc

SEQ ID NO: 451082 - DNA, 512 bp, Homo sapiens; identical to SEQ ID NO: 445688
  misc_feature: HEFZJCU01B2QHB.3.34.D01.1.454.heavy.3.raw

SEQ ID NO: 451083 - DNA, 379 bp, Homo sapiens
  misc_feature: HEFZJCU01DGHDY.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcggggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 451084 - DNA, 481 bp, Homo sapiens; identical to SEQ ID NO: 445517
  misc_feature: HEFZJCU01BNYRK.22.36.D03.1.454.heavy.3.raw

SEQ ID NO: 451085 - DNA, 527 bp, Homo sapiens; identical to SEQ ID NO: 446775
  misc_feature: HEFZJCU01EXHRT.9.78.H01.1.454.heavy.3.raw

SEQ ID NO: 451086 - DNA, 490 bp, Homo sapiens; identical to SEQ ID NO: 446494
  misc_feature: HEFZJCU01CB6WW.11.13.B02.1.454.heavy.3.raw

SEQ ID NO: 451087 - DNA, 495 bp, Homo sapiens
  misc_feature: HEFZJCU01DRZGL.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctccccagcctccaccaagggcccatcggtcttcccctggcaccctcctccaagagcacctctgggggcacagcggcctgggctgcctggtcaaggactacttccgagtagtaca

SEQ ID NO: 451088 - DNA, 399 bp, Homo sapiens
  misc_feature: HEFZJCU01BQZAS.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttctacgtgagct

SEQ ID NO: 451089 - DNA, 522 bp, Homo sapiens; identical to SEQ ID NO: 449155
  misc_feature: HEFZJCU01AJU94.12.71.G05.1.454.heavy.3.raw

SEQ ID NO: 451090 - DNA, 511 bp, Homo sapiens
  misc_feature: HEFZJCU01DDHXF.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctgggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 451091 - DNA, 403 bp, Homo sapiens; identical to SEQ ID NO: 444540
  misc_feature: HEFZJCU01BPA7W.16.72.G06.1.454.heavy.3.raw

SEQ ID NO: 451092 - DNA, 510 bp, Homo sapiens
  misc_feature: HEFZJCU01B5RN3.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaggactactcccata

SEQ ID NO: 451093 - DNA, 500 bp, Homo sapiens; identical to SEQ ID NO: 446033
  misc_feature: HEFZJCU01A2EBI.11.27.C05.1.454.heavy.3.raw

SEQ ID NO: 451094 - DNA, 523 bp, Homo sapiens
  misc_feature: HEFZJCU01CUN3R.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctttgggctggatcaacccttacaccggtcgcccaaactatgcagcgtcttttcggaacagggtcaccctgacctgggacgcgtcccgcaatacagcctccatggaattgaccacactgaaatctggcgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacacg

SEQ ID NO: 451095 - DNA, 553 bp, Homo sapiens
  misc_feature: HEFZJCU01BYIH4.52.14.B03.1.454.heavy.3.raw
cgcagtacgacacgaccggtgctcgatttagtgtgagtagttcccggggggacctcctgtgcaagaacatgaagcacctgtggttcgtcctcctgctggtggcggctcccagatgggtcctgtcccagctgcaactgcaggagtcgggcccaggactggtgaagccttcggagaccctgtccctcacctgcactgtctctggtggctccatcagcagtagtgattactactggggctggatccgccagcccccagggaaggggctggagtggattgggagtgtcttttatagtggaaacacctactacaacccgtccctcaagagtcgagtcaccatatcagtagacacgtccaagagccagttctccctgaagctgacgtctctgaacgccgcggacacggccgtttattactgtgcgagtaccccggtaacctttttacgatttttggagtggatactataccggtatgggggccttttgacttctggggccagggaaccctggtcaccgtctcctcagcctccaccaagggcccatcggtccttcccctc

SEQ ID NO: 451096 - DNA, 509 bp, Homo sapiens; identical to SEQ ID NO: 450407
  misc_feature: HEFZJCU01A172Q.13.39.D06.1.454.heavy.3.raw

SEQ ID NO: 451097 - DNA, 494 bp, Homo sapiens
  misc_feature: HEFZJCU01DO1P0.16.37.D04.1.454.heavy.3.raw
tgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcgtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 451098 - DNA, 497 bp, Homo sapiens
  misc_feature: HEFZJCU01DYFSE.52.70.G04.1.454.heavy.3.raw
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattactgtgcgagggtcggcacgctgacaacctcttacttctattcctacgctatgg

SEQ ID NO: 451099 - DNA, 525 bp, Homo sapiens
  misc_feature: HEFZJCU01AE1R2.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacc

SEQ ID NO: 451100 - DNA, 523 bp, Homo sapiens
  misc_feature: HEFZJCU01B4648.12.40.D07.1.454.heavy.3.raw
atacgacgtacacgaccggtgctcgatttagtgatagagcgtaacaacagaggactcaccatggagtttgggctgagcgtggtttcgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcg

SEQ ID NO: 451101 - DNA, 514 bp, Homo sapiens
  misc_feature: HEFZJCU01CCQ8T.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctaacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctgggccaggggacctggtcatcgtctccccagcctcaccaaggccatcggtctcccctgcg

SEQ ID NO: 451102 - DNA, 512 bp, Homo sapiens
  misc_feature: HEFZJCU01EHOW5.53.70.G04.1.454.heavy.3.raw
cgcgtatacacacgaccggtgctcgatttagtgtagtgtgaagggaaagggtggagtctgggggagacttgatacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttccccctggcgccctgctccaggagcacctccgacgagcacagcggccctgggctgcctggtcaaggactactt

SEQ ID NO: 451103 - DNA, 515 bp, Homo sapiens; identical to SEQ ID NO: 447834
  misc_feature: HEFZJCU01EH3FO.3.20.B09.1.454.heavy.3.raw

SEQ ID NO: 451104 - DNA, 488 bp, Homo sapiens
  misc_feature: HEFZJCU01EH0X4.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctgcgccctgctccaggagcacctccgagagcacagcggccctgggctgcctggtcaaggactacttcccatactcgta

SEQ ID NO: 451105 - DNA, 512 bp, Homo sapiens; identical to SEQ ID NO: 445688
  misc_feature: HEFZJCU01AGJHN.3.34.D01.1.454.heavy.3.raw

SEQ ID NO: 451106 - DNA, 544 bp, Homo sapiens
  misc_feature: HEFZJCU01C2DPW.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtccttccccctggtccaccctccctccaacgagccacctctggggggcacagcc

SEQ ID NO: 451107 - DNA, 498 bp, Homo sapiens; identical to SEQ ID NO: 445952
  misc_feature: HEFZJCU01BT2IC.11.71.G05.1.454.heavy.3.raw

SEQ ID NO: 451108 - DNA, 483 bp, Homo sapiens; identical to SEQ ID NO: 444639
  misc_feature: HEFZJCU01EB1M1.11.23.C01.1.454.heavy.3.raw

SEQ ID NO: 451109 - DNA, 484 bp, Homo sapiens
  misc_feature: HEFZJCU01DG041.51.78.H01.1.454.heavy.3.raw
cgatcgtatacacgaccggtgctcgatttagtgtgagtagtttgggtttgggcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtggctggccacatcatgcttttgatatctggagccaagggacaatggtc

SEQ ID NO: 451110 - DNA, 351 bp, Homo sapiens
  misc_feature: HEFZJCU01CPONZ.10.38.D05.1.454.heavy.3.raw
catagtagtgcacgaccggtgctcgatttagtatctgatagttgggtttggggggaagaggaagactgacggtcctgccacaggtggtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgcctgctccaggagcacctccgagagcacagcggccctgggctgcctggtcaaggactacttcccactactatg

SEQ ID NO: 451111 - DNA, 500 bp, Homo sapiens; identical to SEQ ID NO: 444529
  misc_feature: HEFZJCU01DXKVO.12.38.D05.1.454.heavy.3.raw

SEQ ID NO: 451112 - DNA, 398 bp, Homo sapiens
  misc_feature: HEFZJCU01BGSD7.47.46.E02.1.454.heavy.3.raw
agctcacgtacacgaccggtgctcgatttagactcatctacaggggaaaggggctggagtgggtctcaagtattgatgagaatggtggaagcacattctacgtggactccgtgaagggccggttcaccatctccagagacaatttcaggagcacgctgtatcctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 451113 - DNA, 523 bp, Homo sapiens
  misc_feature: HEFZJCU01CZ8KL.53.78.H01.1.454.heavy.3.raw
cgcgtatacacacgaccggtgctcgatttagtgtgagtagtttgggtttgggggagcatcacataacaaccagattcctcctctaaagaagcccctgggagcacagctcatcaccatggactggacctggaggttcctctttgtggtggcagcagttacaggtgtccagtcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccac

SEQ ID NO: 451114 - DNA, 515 bp, Homo sapiens
  misc_feature: HEFZJCU01D8OYN.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaggactacttcctatgtata

SEQ ID NO: 451115 - DNA, 522 bp, Homo sapiens
  misc_feature: HEFZJCU01BMFIH.3.55.E11.1.454.heavy.3.raw
agacgcactccacgaccggtgctcgatttagcactcgcacgttgggtttgggctgagcggtggtttcgtcgtaggctctttaagtaaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttcagactactggggccagggaaccctggtcaccgtctcctcagcctccaccaagggcccatcggtcttccccctggcaccctcctcccaag

SEQ ID NO: 451116 - DNA, 481 bp, Homo sapiens
  misc_feature: HEFZJCU01DI5EH.52.15.B04.1.454.heavy.3.raw
cgcagtacgacacgaccggtgctcgatttagacagtatatatccgcggggagctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgagggccgattcaccatatccagagacaactccccaagatgtgatatatctacaatagaacagcctgagacctgaggacacggctgtatattattgtgcgtcga

SEQ ID NO: 451117 - DNA, 506 bp, Homo sapiens; identical to SEQ ID NO: 446520
  misc_feature: HEFZJCU01ANDOP.10.38.D05.1.454.heavy.3.raw

SEQ ID NO: 451118 - DNA, 486 bp, Homo sapiens
  misc_feature: HEFZJCU01BDC5D.51.78.H01.1.454.heavy.3.raw
cgatcgtatacacgaccggtgctcgatttagtgtgagtagtttgggtttggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 451119 - DNA, 493 bp, Homo sapiens
  misc_feature: HEFZJCU01CWCTR.52.78.H01.1.454.heavy.3.raw
cgcagtacgacacgaccggtgctcgatttagtgtgagtagtttgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 451120 - DNA, 505 bp, Homo sapiens
  misc_feature: HEFZJCU01CY4DS.52.86.H09.1.454.heavy.3.raw
  modified_base (148)..(148): a, c, t, g, unknown or other
cgcagtacgacacgaccggtgctcgatttagtgctatagacttgggtttggggctcggagaggagccttagccctggactccaaggcctttccacttggtgatcagcactgagcacagaggactcaccatggagttggggctgagcgnggtttcgtgtaggctatttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaaggccgattcaccacttccagagacaacatcaagaactcaatgtatctccaaattgagcagccttgacatccgaggacacggcccgtgtaattactgtgcgagagttctttgggatgttgtcgttggca

SEQ ID NO: 451121 - DNA, 506 bp, Homo sapiens
  misc_feature: HEFZJCU01CDZDL.48.39.D06.1.454.heavy.3.raw
agtatacatacacgaccggtgctcgatttagtgacatctcgcagttctttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtggggccgaagggacaatggtcaccgtctcttcagcctccacccg

SEQ ID NO: 451122 - DNA, 492 bp, Homo sapiens; identical to SEQ ID NO: 444827
  misc_feature: HEFZJCU01CYMUO.4.28.C06.1.454.heavy.3.raw

SEQ ID NO: 451123 - DNA, 505 bp, Homo sapiens; identical to SEQ ID NO: 445664
  misc_feature: HEFZJCU01DKGOK.12.33.C11.1.454.heavy.3.raw

SEQ ID NO: 451124 - DNA, 464 bp, Homo sapiens; identical to SEQ ID NO: 445533
  misc_feature: HEFZJCU01BBWHK.19.10.A10.1.454.heavy.3.raw

SEQ ID NO: 451125 - DNA, 506 bp, Homo sapiens
  misc_feature: HEFZJCU01DZYBA.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 451126 - DNA, 492 bp, Homo sapiens; identical to SEQ ID NO: 444695
  misc_feature: HEFZJCU01EGOWE.3.34.D01.1.454.heavy.3.raw

SEQ ID NO: 451127 - DNA, 495 bp, Homo sapiens
  misc_feature: HEFZJCU01A91QF.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctggggcacagcggccctgggctgcctggtcaaggactacttccgagtagtaca

SEQ ID NO: 451128 - DNA, 521 bp, Homo sapiens
  misc_feature: HEFZJCU01D8SS0.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacacgcggccc

SEQ ID NO: 451129 - DNA, 536 bp, Homo sapiens
  misc_feature: HEFZJCU01ESYYB.16.39.D06.1.454.heavy.3.raw
tgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtgcgaaagacgtatgtagtggtgactgctttgtttggagtcttttgactactggggccagggtaacccg

SEQ ID NO: 451130 - DNA, 491 bp, Homo sapiens
  misc_feature: HEFZJCU01EPWTF.51.81.H04.1.454.heavy.3.raw
cgatcgtatacacgaccggtgctcgatttagtagtgtagattcgcgggggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcag

SEQ ID NO: 451131 - DNA, 410 bp, Homo sapiens
  misc_feature: HEFZJCU01COM92.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactgggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 451132 - DNA, 491 bp, Homo sapiens; identical to SEQ ID NO: 444592
  misc_feature: HEFZJCU01DSHP2.11.26.C04.1.454.heavy.3.raw

SEQ ID NO: 451133 - DNA, 316 bp, Homo sapiens; identical to SEQ ID NO: 444444
  misc_feature: HEFZJCU01BICJ8.47.56.F01.1.454.heavy.3.raw

SEQ ID NO: 451134 - DNA, 385 bp, Homo sapiens; identical to SEQ ID NO: 444438
  misc_feature: HEFZJCU01AT437.18.60.F05.1.454.heavy.3.raw

SEQ ID NO: 451135 - DNA, 508 bp, Homo sapiens
  misc_feature: HEFZJCU01C7NJW.52.86.H09.1.454.heavy.3.raw
cgcagtacgacacgaccggtgctcgatttagtgctatagacttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcagccctcgaagaacatcatgatggctttgatatctggggccaagggacaatggtcattgtctcttcagtcctccaccaagggcccagtcggtcttcccccg

SEQ ID NO: 451136 - DNA, 511 bp, Homo sapiens; identical to SEQ ID NO: 448280
  misc_feature: HEFZJCU01EG8DF.16.71.G05.1.454.heavy.3.raw

SEQ ID NO: 451137 - DNA, 387 bp, Homo sapiens; identical to SEQ ID NO: 444930
  misc_feature: HEFZJCU01BL8UE.16.59.F04.1.454.heavy.3.raw

SEQ ID NO: 451138 - DNA, 497 bp, Homo sapiens
  misc_feature: HEFZJCU01CEBRR.52.85.H08.1.454.heavy.3.raw
cgcagtacgacacgaccggtgctcgatttagtatcactcagtcgcgggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctcatcgttttagctcctggggccagggaaccctggtctccgt

SEQ ID NO: 451139 - DNA, 324 bp, Homo sapiens; identical to SEQ ID NO: 444475
  misc_feature: HEFZJCU01E0MN0.18.17.B06.1.454.heavy.3.raw

SEQ ID NO: 451140 - DNA, 507 bp, Homo sapiens
  misc_feature: HEFZJCU01B2GZ6.11.40.D07.1.454.heavy.3.raw
cgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggctccaggcaagggactggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcaggggtggccagtacagtcatacatttgccaactggggccagggaaccctgggtcatcgtctcctcagcctccacccg

SEQ ID NO: 451141 - DNA, 497 bp, Homo sapiens
  misc_feature: HEFZJCU01DKQ91.53.4.A04.1.454.heavy.3.raw
cgcgtatacacacgaccggtgctcgatttagagtagtgatcaggggagctctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccaggcaagggcctggagtgggtggcacttatatcatatgatggaggtgataaatactacgcagactccgtgaagggccgattcgccatctccagagacaattccaagaacaccctctatctacaaatgaagagactgagacctgaggacacggctgtctattactgtgcgagagtcggctttagagatgcctac

SEQ ID NO: 451142 - DNA, 399 bp, Homo sapiens; identical to SEQ ID NO: 444537
  misc_feature: HEFZJCU01CQC3O.16.29.C07.1.454.heavy.3.raw

SEQ ID NO: 451143 - DNA, 523 bp, Homo sapiens; identical to SEQ ID NO: 450895
  misc_feature: HEFZJCU01CD27F.11.25.C03.1.454.heavy.3.raw

SEQ ID NO: 451144 - DNA, 500 bp, Homo sapiens
  misc_feature: HEFZJCU01CAMRC.10.34.D01.1.454.heavy.3.raw
  modified_base (443)..(443): a, c, t, g, unknown or other
catagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccgagggaaggggctggagtgggttggccatattaaaatcaaagctgatggtgggacaacagagcacgctgcacccgtgaaaggcagattcagcatctcaagagatgattcaaaaagtacgctgtatctgaacatgaacngcctagaaaacggaggacacagccgtgtattactgtgccactcaggaccgatattgt

SEQ ID NO: 451145 - DNA, 538 bp, Homo sapiens
  misc_feature: HEFZJCU01BYFZH.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaaccctggtcaccgtctcctcagcctccaccaagggcccatcggtcttccccctggccaccctcctccaagacg

SEQ ID NO: 451146 - DNA, 396 bp, Homo sapiens; identical to SEQ ID NO: 444469
  misc_feature: HEFZJCU01DWCRY.47.46.E02.1.454.heavy.3.raw

SEQ ID NO: 451147 - DNA, 483 bp, Homo sapiens
  misc_feature: HEFZJCU01B07AK.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctggggcacagtggccctgggctgcctggtcaaggactacttccgtatctctcg

SEQ ID NO: 451148 - DNA, 521 bp, Homo sapiens
  misc_feature: HEFZJCU01CQYZ5.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctcgtgggggcacgagcggccctgggctgcctggtccaaggactacttccagacgtatca

SEQ ID NO: 451149 - DNA, 514 bp, Homo sapiens
  misc_feature: HEFZJCU01AO7XO.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttg

SEQ ID NO: 451150 - DNA, 524 bp, Homo sapiens; identical to SEQ ID NO: 445902
  misc_feature: HEFZJCU01AN3PL.9.78.H01.1.454.heavy.3.raw

SEQ ID NO: 451151 - DNA, 512 bp, Homo sapiens
  misc_feature: HEFZJCU01EH9Z7.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactacgtggggccagggaaccctggtcaccgt

SEQ ID NO: 451152 - DNA, 518 bp, Homo sapiens
  misc_feature: HEFZJCU01C3GP6.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 451153 - DNA, 408 bp, Homo sapiens; identical to SEQ ID NO: 444522
  misc_feature: HEFZJCU01BXTV0.3.41.D08.1.454.heavy.3.raw

SEQ ID NO: 451154 - DNA, 496 bp, Homo sapiens
  misc_feature: HEFZJCU01DCG85.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgataggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttatattgtgcaataagaattgcaacgatgctttgatatgtgggaccg

SEQ ID NO: 451155 - DNA, 505 bp, Homo sapiens
  misc_feature: HEFZJCU01EWPRX.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 451156 - DNA, 503 bp, Homo sapiens
  misc_feature: HEFZJCU01ASJ05.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgatgttttgattggtttttacg

SEQ ID NO: 451157 - DNA, 524 bp, Homo sapiens
  misc_feature: HEFZJCU01E1X5L.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttcttggtatttcgatctctggggccgtggcaccctggtcactgtctcctcggcttccaccaacgggccatcggtcttcccctggcgccctcgctccaggagcacctcgtcggggggtcaccgagccggtcccc

SEQ ID NO: 451158 - DNA, 489 bp, Homo sapiens; identical to SEQ ID NO: 444791
  misc_feature: HEFZJCU01B8KTH.47.85.H08.1.454.heavy.3.raw

SEQ ID NO: 451159 - DNA, 523 bp, Homo sapiens
  misc_feature: HEFZJCU01AP1A0.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgcctgctccaggagcacctccgagagcacagcggccctgggctgcctggtcaaggactacttcc

SEQ ID NO: 451160 - DNA, 464 bp, Homo sapiens; identical to SEQ ID NO: 445533
  misc_feature: HEFZJCU01EY5K9.19.10.A10.1.454.heavy.3.raw

SEQ ID NO: 451161 - DNA, 483 bp, Homo sapiens
  misc_feature: HEFZJCU01BZE88.19.52.E08.1.454.heavy.3.raw
tactctcgtgcacgaccggtgctcgatttagtcgagctctcccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaggcggt

SEQ ID NO: 451162 - DNA, 506 bp, Homo sapiens
  misc_feature: HEFZJCU01EMKJ5.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctgggcc

SEQ ID NO: 451163 - DNA, 503 bp, Homo sapiens
  misc_feature: HEFZJCU01BOMMY.51.53.E09.1.454.heavy.3.raw
cgatcgtatacacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcacg

SEQ ID NO: 451164 - DNA, 383 bp, Homo sapiens
  misc_feature: HEFZJCU01AO8KI.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggaaccctggtcaccgtctccccaccctccaccaaggcccatcggtcttccccctggcaccctcctccaacgagcacctctggggcacagcggccctggctgcctggtcaaggactacttcccatactcgta

SEQ ID NO: 451165 - DNA, 400 bp, Homo sapiens; identical to SEQ ID NO: 444452
  misc_feature: HEFZJCU01CJL1Q.47.24.C02.1.454.heavy.3.raw

SEQ ID NO: 451166 - DNA, 505 bp, Homo sapiens; identical to SEQ ID NO: 449015
  misc_feature: HEFZJCU01EGBNX.16.34.D01.1.454.heavy.3.raw

SEQ ID NO: 451167 - DNA, 497 bp, Homo sapiens; identical to SEQ ID NO: 445400
  misc_feature: HEFZJCU01DCOEF.40.37.D04.1.454.heavy.3.raw

SEQ ID NO: 451168 - DNA, 387 bp, Homo sapiens; identical to SEQ ID NO: 445235
  misc_feature: HEFZJCU01B23OV.9.63.F08.1.454.heavy.3.raw

SEQ ID NO: 451169 - DNA, 497 bp, Homo sapiens
  misc_feature: HEFZJCU01CG3GU.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttccccctggcgccctgctccaggagcacctccgagagcacagcggccctgggctggcctggtcaaggactactccagtcgctaga

SEQ ID NO: 451170 - DNA, 522 bp, Homo sapiens; identical to SEQ ID NO: 446788
  misc_feature: HEFZJCU01BM3WM.12.40.D07.1.454.heavy.3.raw

SEQ ID NO: 451171 - DNA, 465 bp, Homo sapiens
  misc_feature: HEFZJCU01CV7DV.48.53.E09.1.454.heavy.3.raw
agtatacatacacgaccggtgctcgatttagagagagtgtgttgggtttggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 451172 - DNA, 510 bp, Homo sapiens
  misc_feature: HEFZJCU01EOOTS.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaagtccggggaaatatgtacgtattttggaactt

SEQ ID NO: 451173 - DNA, 532 bp, Homo sapiens; identical to SEQ ID NO: 445228
  misc_feature: HEFZJCU01DCWV4.7.78.H01.1.454.heavy.3.raw

SEQ ID NO: 451174 - DNA, 516 bp, Homo sapiens
  misc_feature: HEFZJCU01A65OB.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagaggtttatggcgatggctgggtggacagatcactgggggccac

SEQ ID NO: 451175 - DNA, 506 bp, Homo sapiens; identical to SEQ ID NO: 444696
  misc_feature: HEFZJCU01DSS1T.16.34.D01.1.454.heavy.3.raw

SEQ ID NO: 451176 - DNA, 483 bp, Homo sapiens; identical to SEQ ID NO: 444924
  misc_feature: HEFZJCU01DGRR7.10.35.D02.1.454.heavy.3.raw

SEQ ID NO: 451177 - DNA, 529 bp, Homo sapiens
  misc_feature: HEFZJCU01D47QB.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatgcctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaac

SEQ ID NO: 451178 - DNA, 481 bp, Homo sapiens; identical to SEQ ID NO: 445006
  misc_feature: HEFZJCU01AOO0D.7.10.A10.1.454.heavy.3.raw

SEQ ID NO: 451179 - DNA, 482 bp, Homo sapiens; identical to SEQ ID NO: 444503
  misc_feature: HEFZJCU01DJ2JR.7.10.A10.1.454.heavy.3.raw

SEQ ID NO: 451180 - DNA, 513 bp, Homo sapiens
  misc_feature: HEFZJCU01D8VP3.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgagggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccactcggtccttcccctcggcaccctcctccaagagcacctctgggggcacagcggccctgggctgcctggtcaaggactacttccgtacacg

SEQ ID NO: 451181 - DNA, 380 bp, Homo sapiens
  misc_feature: HEFZJCU01ERU5V.3.70.G04.1.454.heavy.3.raw
agacgcactccacgaccggtgctcgatttagtgtagtgtgaagggaaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 451182 - DNA, 482 bp, Homo sapiens; identical to SEQ ID NO: 444503
  misc_feature: HEFZJCU01DSOTU.7.10.A10.1.454.heavy.3.raw

SEQ ID NO: 451183 - DNA, 517 bp, Homo sapiens
  misc_feature: HEFZJCU01CTHF0.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggccccatcc

SEQ ID NO: 451184 - DNA, 521 bp, Homo sapiens; identical to SEQ ID NO: 445317
  misc_feature: HEFZJCU01A0J15.12.40.D07.1.454.heavy.3.raw

SEQ ID NO: 451185 - DNA, 396 bp, Homo sapiens; identical to SEQ ID NO: 444433
  misc_feature: HEFZJCU01BRPEN.47.59.F04.1.454.heavy.3.raw

SEQ ID NO: 451186 - DNA, 508 bp, Homo sapiens
  misc_feature: HEFZJCU01BK9IP.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattccaccatctccagagacaattccaagaacacgctgtttcttcaaatgaacagcctgagagccgatgacacggccgtgtattactgtgcgagagagtcggggcccacgaacgttactacgctagtggacgtcgt

SEQ ID NO: 451187 - DNA, 495 bp, Homo sapiens; identical to SEQ ID NO: 450151
  misc_feature: HEFZJCU01BSWTG.51.30.C08.1.454.heavy.3.raw

SEQ ID NO: 451188 - DNA, 540 bp, Homo sapiens
  misc_feature: HEFZJCU01C5562.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttgtccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggctggagtgggttggacgtttcaaaagtaaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatctggggcccagggac

SEQ ID NO: 451189 - DNA, 500 bp, Homo sapiens; identical to SEQ ID NO: 445720
  misc_feature: HEFZJCU01DQ2O0.3.20.B09.1.454.heavy.3.raw

SEQ ID NO: 451190 - DNA, 535 bp, Homo sapiens
  misc_feature: HEFZJCU01EUGYK.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaagcagattcaccatctcaagagatgattcaaaaagcacgctgtatctgcaaatgaacagcctgagaaccgaggacacagccgtgtattactgtaccacatccctgaaagcgtcaactactactactacggtatggacctctggggaccg

SEQ ID NO: 451191 - DNA, 507 bp, Homo sapiens
  misc_feature: HEFZJCU01EJQ7B.49.10.A10.1.454.heavy.3.raw
agtcgagagacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggcaaggggctggagtgggtggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggccccccctttcaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 451192 - DNA, 479 bp, Homo sapiens; identical to SEQ ID NO: 450171
  misc_feature: HEFZJCU01CORMP.14.70.G04.1.454.heavy.3.raw

SEQ ID NO: 451193 - DNA, 513 bp, Homo sapiens; identical to SEQ ID NO: 445049
  misc_feature: HEFZJCU01EMX8R.19.26.C04.1.454.heavy.3.raw

SEQ ID NO: 451194 - DNA, 518 bp, Homo sapiens
  misc_feature: HEFZJCU01B812J.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggcagggaacctggtgaccgtctcctcagcctccaccaaggcccatcggtcttcccctggccgccctgctccaggagcacctccgagagcacacgcggccc

SEQ ID NO: 451195 - DNA, 503 bp, Homo sapiens
  misc_feature: HEFZJCU01D9HLE.40.56.F01.1.454.heavy.3.raw
tctagcgactcacgaccggtgctcgatttagcagacgtctgaacacacaaaggggcagctcacatgggaagtgctttctgagagtcatggacctcctgcacaaaacatgaaacacctgtggttcttcctcctcctggtggcagctcccagatgggtcctgtcccagccgcagctacagcagtggggcgcgggactgttgaagccttcggagaccctgtccctcacctgcgctgtcaatggtgagtcctttggtggttatcactggagctggatccgccagtctccccggaggggcctggagtggattggcgaaatcaatcatcgtgaaatcaccaactacaacccgtccctcaagagtcgaatcagtatttctgtagacacgtccaagaagcaattctccctgatgatgagttctctgaccgccgcggacacggctgtgtattctgtgcgagccaacatgaaggcagttgggggagttatggaccctttgagtattggggcca

SEQ ID NO: 451196 - DNA, 522 bp, Homo sapiens
  misc_feature: HEFZJCU01BW7F3.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttatttaccg

SEQ ID NO: 451197 - DNA, 518 bp, Homo sapiens
  misc_feature: HEFZJCU01C80UE.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactactccgagtagtaca

SEQ ID NO: 451198 - DNA, 513 bp, Homo sapiens
  misc_feature: HEFZJCU01AFZZU.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacctgggggcccgggagccctggtcc

SEQ ID NO: 451199 - DNA, 509 bp, Homo sapiens
  misc_feature: HEFZJCU01EK5YE.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggccgccctgctccaggagcacctctgggggc

SEQ ID NO: 451200 - DNA, 493 bp, Homo sapiens
  misc_feature: HEFZJCU01DG4V4.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttgggctgtgctgggtgctccttgttactattttagaaggtgtccactgtggcgtgcacctagtggagtctgggggaggcttggtacagcctggatggtccctgagactctcctgtgcagcctctggatacatcttcaaaagtttcgaaatgagctgggtccgccaggctcctgggaagggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacaagaaaagcggtgg

SEQ ID NO: 451201 - DNA, 497 bp, Homo sapiens
  misc_feature: HEFZJCU01BRH1T.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacggagtactggtacttcgatctctggggccgtggcaccctgctgactgtctcctcagcctccaccaagggcccatcggtcttcccctggcgccctgctccaggagcacctccgagagcacagcggcctgggctgcctggtcaaggactaccg

SEQ ID NO: 451202 - DNA, 516 bp, Homo sapiens
  misc_feature: HEFZJCU01DHHWX.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccggggaaccctggtcgccgtctcctcagcctccaccaagggccatcggtctcccctggcaccctcctccaagagcacctctgggggcacagcggccctggggctgcctggtcaaggactacttccagacgtatca

SEQ ID NO: 451203 - DNA, 502 bp, Homo sapiens
  misc_feature: HEFZJCU01DA3GT.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccg

SEQ ID NO: 451204 - DNA, 528 bp, Homo sapiens; identical to SEQ ID NO: 446983
  misc_feature: HEFZJCU01EB7YO.7.70.G04.1.454.heavy.3.raw

SEQ ID NO: 451205 - DNA, 508 bp, Homo sapiens; identical to SEQ ID NO: 448191
  misc_feature: HEFZJCU01EVYAP.4.67.G01.1.454.heavy.3.raw

SEQ ID NO: 451206 - DNA, 553 bp, Homo sapiens
  misc_feature: HEFZJCU01EB13J.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcgaaacgggggggtactactacgctatggacgtctggggccaagggaccacggtcaccgtctcctcagcctccaccaagggcccatcggtcttcccctcggcaccctcctccaagagcacctctgggggcacg

SEQ ID NO: 451207 - DNA, 412 bp, Homo sapiens
  misc_feature: HEFZJCU01EAWZI.52.30.C08.1.454.heavy.3.raw
cgcagtacgacacgaccggtgctcgatttagtctgacgtcaaagggaaaggggctggagttggtcgcgtcaattagttatagtggtaataacaagaattatgaagagtccgtgaagggccggttcaccatctccagagacaattccaagaacactctgtctctacaaatgaacagcctgagagccgaggacacggccgtatattactgtgcgtcgccaagcctattagcttggttcggggagttactgagagatccttcctttgatatctggggccaagggacaatggtcgtcgtctcttcagcctccaccaagggcccatcggtcttccccctggcaccctcctccaagagcacctctgggggcacagcggccctgggctgcctggtcaaggactacttcctatacgatcg

SEQ ID NO: 451208 - DNA, 445 bp, Homo sapiens
  misc_feature: HEFZJCU01A5SPB.2.41.D08.1.454.heavy.3.raw
acgctcgacacacgaccggtgctcgatttagtcacgcgagaaagggaaaggggctggaatatgttgcaactattactactaatgggggtagtacatattatgcaaactctgtaaagggcagattcaccatctccagagacaattccaagaacaccttatatcttcaaatgggcagcctgagagttgaggacatggctgtgtattactgtgcgagagatgggggatattgtggtggtgattgtcttttatttcgaagaagaggaaacttgggggccgactattataactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 451209 - DNA, 494 bp, Homo sapiens
  misc_feature: HEFZJCU01CG8OU.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgctttgatgtctggggccaagggacaatagtcaccgtctcttcagcctccaccaagggcccatcggtcttcccctggccaccctcctccaagagcacctctgggggcacagcggccctgggctgcctggtcaggactacttcctcgtactgcg

SEQ ID NO: 451210 - DNA, 509 bp, Homo sapiens
  misc_feature: HEFZJCU01BMZNU.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggccccatcggtcttccccctggcgccctgctccagg

SEQ ID NO: 451211 - DNA, 479 bp, Homo sapiens; identical to SEQ ID NO: 450171
  misc_feature: HEFZJCU01AO462.14.70.G04.1.454.heavy.3.raw

SEQ ID NO: 451212 - DNA, 396 bp, Homo sapiens; identical to SEQ ID NO: 444469
  misc_feature: HEFZJCU01ASMAT.47.46.E02.1.454.heavy.3.raw

SEQ ID NO: 451213 - DNA, 505 bp, Homo sapiens
  misc_feature: HEFZJCU01CH0RM.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattaggaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatct

SEQ ID NO: 451214 - DNA, 511 bp, Homo sapiens
  misc_feature: HEFZJCU01A14X9.4.36.D03.1.454.heavy.3.raw
agcactgtagcacgaccggtgctcgatttagctgcgtcacgatctctcttggggttgtctctggagatggtgaatcggccctccacagagtccatatagtgtgtcacaattccatctcgccgaatgttggccacccactccagccccttccctggagactggcggacccaggtcatccaataggtgtcaaaggtgaatccagaggctacacaggagagtctcagggaccccccaggctggaccaagcctcccccagactccaccaattgcccctcacactggacaccttctaaaatagcaacaaggaaaacccagctcagccccaattccatggtgagtcctctgtgctcagtgctgatcaccaagtggaaaggccttggagtccagggctaaggctcctctctgagacctccaccaagggcccatcggtcttccccctggcgccctgctccaggagcacctccgagagcacagcggccctgggctgcctggtcaaggactacttccctac

SEQ ID NO: 451215 - DNA, 518 bp, Homo sapiens; identical to SEQ ID NO: 449770
  misc_feature: HEFZJCU01D0ND8.9.34.D01.1.454.heavy.3.raw

SEQ ID NO: 451216 - DNA, 506 bp, Homo sapiens
  misc_feature: HEFZJCU01CYYWR.48.29.C07.1.454.heavy.3.raw
agtatacatacacgaccggtgctcgatttagagtgctacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 451217 - DNA, 524 bp, Homo sapiens
  misc_feature: HEFZJCU01AY43C.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccccgtggccaccctcctccaagagcacctcgtgggggcacaggccggcccgtgggctgcctggtcaaggactacttccagacgtatca

SEQ ID NO: 451218 - DNA, 505 bp, Homo sapiens
  misc_feature: HEFZJCU01CFM8W.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 451219 - DNA, 498 bp, Homo sapiens
  misc_feature: HEFZJCU01CHKX7.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaaccctggtcaccgtcctcctcagcctccaaccg

SEQ ID NO: 451220 - DNA, 375 bp, Homo sapiens; identical to SEQ ID NO: 445125
  misc_feature: HEFZJCU01A4ICC.9.53.E09.1.454.heavy.3.raw

SEQ ID NO: 451221 - DNA, 519 bp, Homo sapiens
  misc_feature: HEFZJCU01BMRT5.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggtagtgggatatttaa

SEQ ID NO: 451222 - DNA, 518 bp, Homo sapiens; identical to SEQ ID NO: 448653
  misc_feature: HEFZJCU01CJCD9.13.76.G10.1.454.heavy.3.raw

SEQ ID NO: 451223 - DNA, 482 bp, Homo sapiens; identical to SEQ ID NO: 444503
  misc_feature: HEFZJCU01EH9W7.7.10.A10.1.454.heavy.3.raw

SEQ ID NO: 451224 - DNA, 494 bp, Homo sapiens
  misc_feature: HEFZJCU01DDVDD.26.78.H01.1.454.heavy.3.raw
agactatactcacgaccggtgctcgatttagtgtgagtagtttgggtttgggtgcccaagctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgttttactgtgcgagagagatgacgatgtacagtgggaactaccctgatgctttcgatatctggggccaagggacaatggtcaccgtctcttcagcctccaccaagggcccatccggtcttcccctggcaccctccta

SEQ ID NO: 451225 - DNA, 314 bp, Homo sapiens; identical to SEQ ID NO: 444774
  misc_feature: HEFZJCU01CB6RJ.7.10.A10.1.454.heavy.3.raw

SEQ ID NO: 451226 - DNA, 485 bp, Homo sapiens
  misc_feature: HEFZJCU01BDI2M.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctgggggccaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 451227 - DNA, 494 bp, Homo sapiens; identical to SEQ ID NO: 445100
  misc_feature: HEFZJCU01CJ12L.52.53.E09.1.454.heavy.3.raw

SEQ ID NO: 451228 - DNA, 392 bp, Homo sapiens; identical to SEQ ID NO: 444682
  misc_feature: HEFZJCU01BIJEW.16.70.G04.1.454.heavy.3.raw

SEQ ID NO: 451229 - DNA, 514 bp, Homo sapiens
  misc_feature: HEFZJCU01EWUHG.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatagtacgtatttttggaactt

SEQ ID NO: 451230 - DNA, 531 bp, Homo sapiens; identical to SEQ ID NO: 446857
  misc_feature: HEFZJCU01CEFB1.7.78.H01.1.454.heavy.3.raw

SEQ ID NO: 451231 - DNA, 474 bp, Homo sapiens
  misc_feature: HEFZJCU01DGRSA.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgccctgctccaggagcacctccgagagcacagcggccgtgggctgcctggtcaaggactactccgagtgcgtct

SEQ ID NO: 451232 - DNA, 526 bp, Homo sapiens
  misc_feature: HEFZJCU01C5JKM.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctcggcaccctcctccaagacgcacctctcgggggcacagcc

SEQ ID NO: 451233 - DNA, 515 bp, Homo sapiens
  misc_feature: HEFZJCU01CNA2A.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctggggcacagcggcctggctgcctggtcaaggactactcctagagacacg

SEQ ID NO: 451234 - DNA, 542 bp, Homo sapiens
  misc_feature: HEFZJCU01E06AA.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccccgtggggcccgggaacccgtcggtcaccgtctcctcacgcctccaccaacgggcccatcggtcttcccctggccaccctcctccaagacg

SEQ ID NO: 451235 - DNA, 466 bp, Homo sapiens
  misc_feature: HEFZJCU01BFR2V.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 451236 - DNA, 502 bp, Homo sapiens
  misc_feature: HEFZJCU01DZ7O5.48.52.E08.1.454.heavy.3.raw
agtatacatacacgaccggtgctcgatttagtcgagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacaggctggtttcgacccctc

SEQ ID NO: 451237 - DNA, 526 bp, Homo sapiens; identical to SEQ ID NO: 448189
  misc_feature: HEFZJCU01C0Z7C.16.27.C05.1.454.heavy.3.raw
  modified_base (519)..(519): a, c, t, g, unknown or other

SEQ ID NO: 451238 - DNA, 525 bp, Homo sapiens
  misc_feature: HEFZJCU01CAZQW.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagcgcctgacatctgcagactcggcagtatatttctgtgcgagagagggggagagttggttgaggggaaatttggttaattccgaataccttaacttttgaccactgggggccagggggtaa

SEQ ID NO: 451239 - DNA, 397 bp, Homo sapiens
  misc_feature: HEFZJCU01DXNJF.12.69.G03.1.454.heavy.3.raw
atacgacgtacacgaccggtgctcgatttagtcgctgcgtaaaggagaaggggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 451240 - DNA, 524 bp, Homo sapiens; identical to SEQ ID NO: 446153
  misc_feature: HEFZJCU01BHBXI.12.86.H09.1.454.heavy.3.raw

SEQ ID NO: 451241 - DNA, 400 bp, Homo sapiens; identical to SEQ ID NO: 444452
  misc_feature: HEFZJCU01E1KUV.47.24.C02.1.454.heavy.3.raw

SEQ ID NO: 451242 - DNA, 401 bp, Homo sapiens
  misc_feature: HEFZJCU01ACMMC.10.77.G11.1.454.heavy.3.raw
catagtagtgcacgaccggtgctcgatttagctagtcactcaagggaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 451243 - DNA, 491 bp, Homo sapiens
  misc_feature: HEFZJCU01CC619.19.53.E09.1.454.heavy.3.raw
tactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtccaccgtctcctcagcctccaccaagggccatcggtcttcccctggcgccctgctccaggagcacctccgagagcacagccggccctcgggctgcctggtcaaggactacttcccacgagagta

SEQ ID NO: 451244 - DNA, 504 bp, Homo sapiens
  misc_feature: HEFZJCU01DKVOP.26.71.G05.1.454.heavy.3.raw
agactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagatatgactattggggccagggaattttggtcaccgtctccccagcctccaccaac

SEQ ID NO: 451245 - DNA, 523 bp, Homo sapiens
  misc_feature: HEFZJCU01ERNHK.40.67.G01.1.454.heavy.3.raw
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggcttggacatctggggccgaggggcctcc

SEQ ID NO: 451246 - DNA, 506 bp, Homo sapiens
  misc_feature: HEFZJCU01DR338.47.48.E04.1.454.heavy.3.raw
  modified_base (464)..(464): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtntattactgtgtgtctctgacgcctcggccggacttggcttcg

SEQ ID NO: 451247 - DNA, 532 bp, Homo sapiens; identical to SEQ ID NO: 445228
  misc_feature: HEFZJCU01C9EJN.7.78.H01.1.454.heavy.3.raw

SEQ ID NO: 451248 - DNA, 504 bp, Homo sapiens
  misc_feature: HEFZJCU01AD3FN.17.10.A10.1.454.heavy.3.raw
cgtagactagcacgaccggtgctcgatttagcgtcgatctcaggggtccgggagatcatgagggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgtttctgtcatcgtacaatttgataggctctatggactggacttctggggccaggggaccacggtgatcgtctcatcagcctccaccaagggcccatcggtcttcccctggcaccctcctccaagagcacctcg

SEQ ID NO: 451249 - DNA, 384 bp, Homo sapiens; identical to SEQ ID NO: 444454
  misc_feature: HEFZJCU01AVXOA.11.61.F06.1.454.heavy.3.raw

SEQ ID NO: 451250 - DNA, 498 bp, Homo sapiens; identical to SEQ ID NO: 449824
  misc_feature: HEFZJCU01CBR3Y.47.38.D05.1.454.heavy.3.raw

SEQ ID NO: 451251 - DNA, 486 bp, Homo sapiens
  misc_feature: HEFZJCU01C4N70.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatccggtcttcccctggcgccctgctccaggagcacctccgagagcacagcggccctgggctgcctggtcaaggactactcctacgtgagct

SEQ ID NO: 451252 - DNA, 505 bp, Homo sapiens
  misc_feature: HEFZJCU01DO3V1.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggtacttcgtgggccagggaa

SEQ ID NO: 451253 - DNA, 491 bp, Homo sapiens; identical to SEQ ID NO: 446104
  misc_feature: HEFZJCU01E10O4.3.34.D01.1.454.heavy.3.raw

SEQ ID NO: 451254 - DNA, 471 bp, Homo sapiens
  misc_feature: HEFZJCU01DT7QK.4.36.D03.1.454.heavy.3.raw
agcactgtagcacgaccggtgctcgatttagctgcgtcacgatctctcctgtgtagcctctggattccacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttccctacagtgct

SEQ ID NO: 451255 - DNA, 537 bp, Homo sapiens
  misc_feature: HEFZJCU01A5S0W.48.40.D07.1.454.heavy.3.raw
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaagggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactattggggtcggggaaccctggt

SEQ ID NO: 451256 - DNA, 509 bp, Homo sapiens; identical to SEQ ID NO: 445824
  misc_feature: HEFZJCU01BTOY6.9.14.B03.1.454.heavy.3.raw

SEQ ID NO: 451257 - DNA, 396 bp, Homo sapiens; identical to SEQ ID NO: 445898
  misc_feature: HEFZJCU01EAGDX.10.42.D09.1.454.heavy.3.raw

SEQ ID NO: 451258 - DNA, 495 bp, Homo sapiens
  misc_feature: HEFZJCU01C7BNU.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgctacttttt

SEQ ID NO: 451259 - DNA, 400 bp, Homo sapiens; identical to SEQ ID NO: 444452
  misc_feature: HEFZJCU01DKOIR.47.24.C02.1.454.heavy.3.raw

SEQ ID NO: 451260 - DNA, 500 bp, Homo sapiens; identical to SEQ ID NO: 444529
  misc_feature: HEFZJCU01APQ0O.12.38.D05.1.454.heavy.3.raw

SEQ ID NO: 451261 - DNA, 397 bp, Homo sapiens
  misc_feature: HEFZJCU01EV8BL.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgcccaaacgtggatatagtggctaactttgactactggggccagggaaccctggtcaccgtctcctcagcctccaccaagggcccatcggtcttccccctggcgccctgctccaggagcacctccgagagcacagcggccctgggctgcctggtcaaggactacttccctacagtgct

SEQ ID NO: 451262 - DNA, 524 bp, Homo sapiens
  misc_feature: HEFZJCU01D0JQT.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccacc

SEQ ID NO: 451263 - DNA, 501 bp, Homo sapiens
  misc_feature: HEFZJCU01CK632.51.71.G05.1.454.heavy.3.raw
cgatcgtatacacgaccggtgctcgatttagtgtcgtcgcaagagagagggcatcatccaacaaccacatcccttctctacagaagcctctgagaggaaagttcttcaccatggactggacctggagggtcttctgcttgctggctgtagctccaggtgctcactccctggtgcagctggtgcagtctggggctgaggtgaagaagcctggggcctcagtgacgatttcctgtaggacatctggatacacgttcaccggctattttatgtactgggtgcgacaggcccctggacaaggccttgagtggatgggaaagatcaaccctagtggtggtaccacaagttacgcccagaaattccagggcagagtctccatgaccagaaatacgtccgcgaggacagtctacatggagttgagcagcctgagaactgacgacacggccatatattactgtgcgagagaccttgctggtccttttgacttctggggccagggaaccc

SEQ ID NO: 451264 - DNA, 532 bp, Homo sapiens
  misc_feature: HEFZJCU01DWHEA.49.38.D05.1.454.heavy.3.raw
agtcgagagacacgaccggtgctcgatttagtatctgatagttgggtttggggacccaacaaccacatccctcctcagaagcccccagagcacaacgcctcaccatggactggacctggaggatcctctttttggtggcagcagccacaggtgcccactcccaggtccagcttgtgtagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcagtgggatttgactacgtggggccgacgggaaccccggtcgaccgtctcctctcgcctccaaccg

SEQ ID NO: 451265 - DNA, 540 bp, Homo sapiens
  misc_feature: HEFZJCU01CRJI5.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctcccaggagcacctccgtaggggcgacgaacgcggccggtccggtcgggtcgtcgtccggttcggacggaacggtaccttaccctcctaac

SEQ ID NO: 451266 - DNA, 487 bp, Homo sapiens
  misc_feature: HEFZJCU01CI6MX.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggatttttccttttggctattttaaaaggtgtccagtgtgaagtgcagctggtggagtctgggggaggcttaaaggtcagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtataggc

SEQ ID NO: 451267 - DNA, 379 bp, Homo sapiens; identical to SEQ ID NO: 444450
  misc_feature: HEFZJCU01BJEQ5.47.77.G11.1.454.heavy.3.raw

SEQ ID NO: 451268 - DNA, 511 bp, Homo sapiens
  misc_feature: HEFZJCU01A9UZC.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggccaccctcctccaagagcacctctgggggcacagcggccctgggctgcctggtcaaggactacttcctacgtcgtat

SEQ ID NO: 451269 - DNA, 500 bp, Homo sapiens
  misc_feature: HEFZJCU01A1LAC.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagtacggacgattacgacgttttgattggtacg

SEQ ID NO: 451270 - DNA, 487 bp, Homo sapiens; identical to SEQ ID NO: 445077
  misc_feature: HEFZJCU01DYMPG.47.85.H08.1.454.heavy.3.raw

SEQ ID NO: 451271 - DNA, 501 bp, Homo sapiens
  misc_feature: HEFZJCU01A4O2G.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcgtctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 451272 - DNA, 526 bp, Homo sapiens; identical to SEQ ID NO: 447476
  misc_feature: HEFZJCU01BNVH5.14.55.E11.1.454.heavy.3.raw

SEQ ID NO: 451273 - DNA, 398 bp, Homo sapiens
  misc_feature: HEFZJCU01A11BQ.16.29.C07.1.454.heavy.3.raw
tgtactactccacgaccggtgctcgatttagagtgctacgaagggaaaggggctggagtgggtctcagctattagtattagtggtgatagcacatactacgcagactccgtgaagggccggttcaccatctccagagacaattccaagaatatgttgtatctgcaaatgaacagcctgagagccgaggacacggccgtatattactgtgcgaaagatgtaaagtgggcgctactggactcgggggcttttgatatctggggccaagggacaatggtcaccgtctcttcagcctccaccaagggcccatcggtcttccccctggcaccctcctccaagagcacctctgggggcacagcggccctgggctgcctggtcaaggatacttccgagtagtaca

SEQ ID NO: 451274 - DNA, 410 bp, Homo sapiens
  misc_feature: HEFZJCU01DO729.53.68.G02.1.454.heavy.3.raw
cgcgtatacacacgaccggtgctcgatttagtcgatagtgaagggaaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggcaccctcctccaagagcacctctggggcacagcggccctgggctgcctggtcaaggactacttcctcgtactgcg

SEQ ID NO: 451275 - DNA, 500 bp, Homo sapiens; identical to SEQ ID NO: 445720
  misc_feature: HEFZJCU01BX61S.3.20.B09.1.454.heavy.3.raw

SEQ ID NO: 451276 - DNA, 464 bp, Homo sapiens; identical to SEQ ID NO: 445533
  misc_feature: HEFZJCU01CWWBK.19.10.A10.1.454.heavy.3.raw

SEQ ID NO: 451277 - DNA, 494 bp, Homo sapiens
  misc_feature: HEFZJCU01EX31I.52.34.D01.1.454.heavy.3.raw
cgcagtacgacacgaccggtgctcgatttagatcgtctgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatagatcg

SEQ ID NO: 451278 - DNA, 495 bp, Homo sapiens; identical to SEQ ID NO: 445359
  misc_feature: HEFZJCU01ES6FH.4.21.B10.1.454.heavy.3.raw

SEQ ID NO: 451279 - DNA, 533 bp, Homo sapiens
  misc_feature: HEFZJCU01C97Z3.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctca

SEQ ID NO: 451280 - DNA, 534 bp, Homo sapiens
  misc_feature: HEFZJCU01EYINS.48.14.B03.1.454.heavy.3.raw
agtatacatacacgaccggtgctcgatttagtgtgagtagttccgcggggctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggaccggccgtcttcgggggccagggacactggttatcgtctcttcacg

SEQ ID NO: 451281 - DNA, 535 bp, Homo sapiens
  misc_feature: HEFZJCU01ERVNC.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactccctgaagcgtcaactactactactacggtatggacctcgtgggaccg

SEQ ID NO: 451282 - DNA, 529 bp, Homo sapiens
  misc_feature: HEFZJCU01DD79M.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagcgaggacacggccatgtattactgtgtggggcatttacttgacccctggggccggggaacccgtggtcaccgtctccccaccctccaccg

SEQ ID NO: 451283 - DNA, 521 bp, Homo sapiens
  misc_feature: HEFZJCU01AKJ9Z.22.41.D08.1.454.heavy.3.raw
acatacgcgtcacgaccggtgctcgatttagtcacgcgagaaagggaaaggggacccaaaaaccacacccctccttgggagaatcccctagatcacagctcctcaccatggactggacctggagcatccttttcttggtggcagcagcaactggtgcccgctctcaggttcaattggtgcagtctggacctgaggtgaagaagcctggggcctcagtgaaggtctcctgcaaggcttctggttacacgtttaggagctatggtatcgtttgggtgcgacaggcccctggacaacggcctgagtggatgggatggatgaacccttctaaagggaaacacaaactatgcagagaggctccagggcagagtcaccatgaccgcagaccacaccaacgaccacagcctacatggagttgaggagtctgagacctgacgacacggccgtatattactgcgcgagagggcgtttctacggtgactatgagtatctcaggcacgtggggccaggggccaccccgtggt

SEQ ID NO: 451284 - DNA, 531 bp, Homo sapiens; identical to SEQ ID NO: 446857
  misc_feature: HEFZJCU01B3AKM.7.78.H01.1.454.heavy.3.raw

SEQ ID NO: 451285 - DNA, 391 bp, Homo sapiens; identical to SEQ ID NO: 446378
  misc_feature: HEFZJCU01D9Q1P.16.24.C02.1.454.heavy.3.raw

SEQ ID NO: 451286 - DNA, 503 bp, Homo sapiens
  misc_feature: HEFZJCU01D416X.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggattacttccgctacgtaga

SEQ ID NO: 451287 - DNA, 491 bp, Homo sapiens; identical to SEQ ID NO: 446104
  misc_feature: HEFZJCU01A3VHI.3.34.D01.1.454.heavy.3.raw

SEQ ID NO: 451288 - DNA, 527 bp, Homo sapiens
  misc_feature: HEFZJCU01DMHBX.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggaccacggctgtgtattactgtgcaaggcagttcgtggaaacagttatgggttgggggagttgggtttttttcgtagtacgggat

SEQ ID NO: 451289 - DNA, 510 bp, Homo sapiens
  misc_feature: HEFZJCU01C13ZT.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctcggtccgcgggactctggggccagggtaacccg

SEQ ID NO: 451290 - DNA, 517 bp, Homo sapiens
  misc_feature: HEFZJCU01C9ILR.10.53.E09.1.454.heavy.3.raw
catagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaatgaacagcctgagagctgaggacacggctgtgtattactgttcgtttggttctgactcggtcgggggaataccttcagctacg

SEQ ID NO: 451291 - DNA, 528 bp, Homo sapiens
  misc_feature: HEFZJCU01BZEDZ.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatggaaccccggtccg

SEQ ID NO: 451292 - DNA, 488 bp, Homo sapiens
  misc_feature: HEFZJCU01DLLKG.19.53.E09.1.454.heavy.3.raw
  modified_base (444)..(444): a, c, t, g, unknown or other
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaaacngtctgagagctgaggacacggccttgtattactgtgcaaggagt

SEQ ID NO: 451293 - DNA, 396 bp, Homo sapiens; identical to SEQ ID NO: 444469
  misc_feature: HEFZJCU01DSUGC.47.46.E02.1.454.heavy.3.raw

SEQ ID NO: 451294 - DNA, 530 bp, Homo sapiens
  misc_feature: HEFZJCU01BMR9K.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggagtctccgacccagcaactggttcgacccctcggggccagggaaccctggtcaccgtctcctcagcctccaccaagggcccatcggtcttcccctcggcaccctcctccaagagcacctctgggggcacacgg

SEQ ID NO: 451295 - DNA, 526 bp, Homo sapiens
  misc_feature: HEFZJCU01BU4ZS.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacgactacggtgactactgggggttcgaccccgtggggccagggaaccctggtcaccgtctcctcagcctccaccg

SEQ ID NO: 451296 - DNA, 539 bp, Homo sapiens
  misc_feature: HEFZJCU01ELAH0.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaagacaaaacgtccgaagtcgttatcactttgactcctggggccagggaaccctggtcagcgtctcttcagcctccaccaagggcccatcggtcttcccctggccaccctcctccaagagcacctctgggggcacagcggccctgggctgcct

SEQ ID NO: 451297 - DNA, 506 bp, Homo sapiens
  misc_feature: HEFZJCU01COOOE.48.79.H02.1.454.heavy.3.raw
agtatacatacacgaccggtgctcgatttagtgtcacacgaagggaaaggggtctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgcccaggctccaggcaaggggctggagtgggtggcagtcataccttctgctggaaggaatatctactacgcgggctcgtgaagggccgattcaccatctccagagacaattccaacaagacactgtatctgcaaatgaacagcctgagggctgaagacacggctgtgtattactgtgcgagaggctatcactatgggttcggggttacg

SEQ ID NO: 451298 - DNA, 400 bp, Homo sapiens; identical to SEQ ID NO: 444452
  misc_feature: HEFZJCU01CSEE3.47.24.C02.1.454.heavy.3.raw

SEQ ID NO: 451299 - DNA, 491 bp, Homo sapiens; identical to SEQ ID NO: 446104
  misc_feature: HEFZJCU01BMCMB.3.34.D01.1.454.heavy.3.raw

SEQ ID NO: 451300 - DNA, 519 bp, Homo sapiens; identical to SEQ ID NO: 444867
  misc_feature: HEFZJCU01CX9X2.9.34.D01.1.454.heavy.3.raw

SEQ ID NO: 451301 - DNA, 403 bp, Homo sapiens; identical to SEQ ID NO: 445456
  misc_feature: HEFZJCU01EFDC4.3.72.G06.1.454.heavy.3.raw

SEQ ID NO: 451302 - DNA, 313 bp, Homo sapiens; identical to SEQ ID NO: 445488
  misc_feature: HEFZJCU01DIDDF.49.8.A08.1.454.heavy.3.raw

SEQ ID NO: 451303 - DNA, 520 bp, Homo sapiens
  misc_feature: HEFZJCU01CJPL6.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagttggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaactatgtggactccgtgaagggccgattcaccatctccagagacaacgacaagaatttagtgtatctgcaaatgagcagcctgagagccgaggacacggctgtgtattattgtgcgag

SEQ ID NO: 451304 - DNA, 505 bp, Homo sapiens
  misc_feature: HEFZJCU01BHFMC.49.31.C09.1.454.heavy.3.raw
agtcgagagacacgaccggtgctcgatttagacgtctcatcaaggaaggaagggacctcaggggtccgggagatcatgagggtgtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggacaatggtcaccgtctcttcagcctccaccaagggcccatcggtcttccccctggcaccctcctccaagagcacctctgggggcacagcggccctgggctgcctggtcaggactacttcctctctcgact

SEQ ID NO: 451305 - DNA, 509 bp, Homo sapiens; identical to SEQ ID NO: 444586
  misc_feature: HEFZJCU01BXS59.12.78.H01.1.454.heavy.3.raw

SEQ ID NO: 451306 - DNA, 511 bp, Homo sapiens
  misc_feature: HEFZJCU01BGS44.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccccgtcggccgcctcgctccaggacg

SEQ ID NO: 451307 - DNA, 488 bp, Homo sapiens
  misc_feature: HEFZJCU01CVW61.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggccccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctgcgccctgctccaggagcacctccgagagcacagcggccctgggctgcctggtcaaggactacttcccatactcgta

SEQ ID NO: 451308 - DNA, 525 bp, Homo sapiens
  misc_feature: HEFZJCU01D7G4N.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccagggcccatcggtccttccccctcggccaccctcctccaagacgccacctctggggggcacac

SEQ ID NO: 451309 - DNA, 416 bp, Homo sapiens; identical to SEQ ID NO: 445111
  misc_feature: HEFZJCU01CUAXF.14.38.D05.1.454.heavy.3.raw

SEQ ID NO: 451310 - DNA, 376 bp, Homo sapiens
  misc_feature: HEFZJCU01CZHCP.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttcccctggcgccctgctccaggagcacctctgggggcacagcggccctgggctgcctggtcaaggactacttcctacgtgagct

SEQ ID NO: 451311 - DNA, 506 bp, Homo sapiens
  misc_feature: HEFZJCU01EX89R.10.38.D05.1.454.heavy.3.raw
  modified_base (432)..(432): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggtctgagcgtgggtttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcanaatctgagagtcgacgacacggccacctattattgtgcgcgacatgactacgctcaattctggggccagggacg

SEQ ID NO: 451312 - DNA, 396 bp, Homo sapiens; identical to SEQ ID NO: 444426
  misc_feature: HEFZJCU01DDXDV.18.31.C09.1.454.heavy.3.raw

SEQ ID NO: 451313 - DNA, 519 bp, Homo sapiens
  misc_feature: HEFZJCU01CDTOU.49.6.A06.1.454.heavy.3.raw
agtcgagagacacgaccggtgctcgatttagatctactgacaggggtctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtgcgaaagttcgcgtgctaggtacatttgacttactggggccagggtaaaccg

SEQ ID NO: 451314 - DNA, 535 bp, Homo sapiens
  misc_feature: HEFZJCU01B00Z9.12.86.H09.1.454.heavy.3.raw
atacgacgtacacgaccggtgctcgatttagtgctatagacttgggtttggggggaagaggaagactgacggtcctgcaacaggtgcccactccccagttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaacccgtggtgaccgtctcctcagcctccaccaagggcccatcggtccttcccccgtcggccgccctgcctccgaggagccacctccgagacgcacacgccggcccgtc

SEQ ID NO: 451315 - DNA, 523 bp, Homo sapiens
  misc_feature: HEFZJCU01BU692.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgt

SEQ ID NO: 451316 - DNA, 511 bp, Homo sapiens
  misc_feature: HEFZJCU01EOK3P.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacacagccgtctattactgtgttagggtagttttacgtatttttggta

SEQ ID NO: 451317 - DNA, 516 bp, Homo sapiens
  misc_feature: HEFZJCU01EOEFA.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgtttactacgctagtggacgtcgtggggaccg

SEQ ID NO: 451318 - DNA, 480 bp, Homo sapiens; identical to SEQ ID NO: 446171
  misc_feature: HEFZJCU01C8PDP.22.36.D03.1.454.heavy.3.raw

SEQ ID NO: 451319 - DNA, 480 bp, Homo sapiens; identical to SEQ ID NO: 445011
  misc_feature: HEFZJCU01BLWX4.22.36.D03.1.454.heavy.3.raw

SEQ ID NO: 451320 - DNA, 497 bp, Homo sapiens
  misc_feature: HEFZJCU01CE71Q.12.14.B03.1.454.heavy.3.raw
atacgacgtacacgaccggtgctcgatttagtgtgagtagttccgcggggggggaggcttggttcggcctggcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccaggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 451321 - DNA, 519 bp, Homo sapiens; identical to SEQ ID NO: 446650
  misc_feature: HEFZJCU01BSQ6W.13.76.G10.1.454.heavy.3.raw

SEQ ID NO: 451322 - DNA, 503 bp, Homo sapiens
  misc_feature: HEFZJCU01CKHG5.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaacccaagaactcactgttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctggctgcctggtcaaggctactccgagtgcgtct

SEQ ID NO: 451323 - DNA, 316 bp, Homo sapiens; identical to SEQ ID NO: 444444
  misc_feature: HEFZJCU01CFJ1A.47.56.F01.1.454.heavy.3.raw

SEQ ID NO: 451324 - DNA, 509 bp, Homo sapiens; identical to SEQ ID NO: 445824
  misc_feature: HEFZJCU01BOQFN.9.14.B03.1.454.heavy.3.raw

SEQ ID NO: 451325 - DNA, 505 bp, Homo sapiens; identical to SEQ ID NO: 444759
  misc_feature: HEFZJCU01DVM6I.10.38.D05.1.454.heavy.3.raw

SEQ ID NO: 451326 - DNA, 518 bp, Homo sapiens; identical to SEQ ID NO: 444718
  misc_feature: HEFZJCU01BV1CM.9.34.D01.1.454.heavy.3.raw

SEQ ID NO: 451327 - DNA, 513 bp, Homo sapiens; identical to SEQ ID NO: 445573
  misc_feature: HEFZJCU01B7Q4C.52.34.D01.1.454.heavy.3.raw

SEQ ID NO: 451328 - DNA, 483 bp, Homo sapiens
  misc_feature: HEFZJCU01EC0F3.2.33.C11.1.454.heavy.3.raw
acgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 451329 - DNA, 395 bp, Homo sapiens; identical to SEQ ID NO: 444517
  misc_feature: HEFZJCU01BB4NE.16.68.G02.1.454.heavy.3.raw

SEQ ID NO: 451330 - DNA, 519 bp, Homo sapiens
  misc_feature: HEFZJCU01D8OOL.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccgacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 451331 - DNA, 483 bp, Homo sapiens; identical to SEQ ID NO: 444532
  misc_feature: HEFZJCU01BBVVB.47.59.F04.1.454.heavy.3.raw

SEQ ID NO: 451332 - DNA, 506 bp, Homo sapiens; identical to SEQ ID NO: 444696
  misc_feature: HEFZJCU01CI68W.16.34.D01.1.454.heavy.3.raw

SEQ ID NO: 451333 - DNA, 506 bp, Homo sapiens
  misc_feature: HEFZJCU01ENHD7.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggacacatgacaccg

SEQ ID NO: 451334 - DNA, 497 bp, Homo sapiens; identical to SEQ ID NO: 444995
  misc_feature: HEFZJCU01BT2FT.4.26.C04.1.454.heavy.3.raw

SEQ ID NO: 451335 - DNA, 423 bp, Homo sapiens; identical to SEQ ID NO: 446550
  misc_feature: HEFZJCU01A17KG.11.22.B11.1.454.heavy.3.raw

SEQ ID NO: 451336 - DNA, 486 bp, Homo sapiens; identical to SEQ ID NO: 448316
  misc_feature: HEFZJCU01A35BS.3.48.E04.1.454.heavy.3.raw

SEQ ID NO: 451337 - DNA, 512 bp, Homo sapiens; identical to SEQ ID NO: 447541
  misc_feature: HEFZJCU01CXA9S.12.55.E11.1.454.heavy.3.raw

SEQ ID NO: 451338 - DNA, 511 bp, Homo sapiens; identical to SEQ ID NO: 446224
  misc_feature: HEFZJCU01BH1O6.7.28.C06.1.454.heavy.3.raw

SEQ ID NO: 451339 - DNA, 511 bp, Homo sapiens
  misc_feature: HEFZJCU01AWTGF.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggacttctggggccagggtaacccg

SEQ ID NO: 451340 - DNA, 547 bp, Homo sapiens
  misc_feature: HEFZJCU01EDI6P.40.87.H10.1.454.heavy.3.raw
tctagcgactcacgaccggtgctcgatttagcagtactgcgttgggtttggggtctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccggggggtccctgagactcgcctgtacagcctctggactcacctttagaaatgatgccttgagctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaaagaaccctctattgtagtggtggaagttgtaactactactttgattcctggggtccaggggtaacccg

SEQ ID NO: 451341 - DNA, 507 bp, Homo sapiens
  misc_feature: HEFZJCU01CDI2S.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggtttcgaggct

SEQ ID NO: 451342 - DNA, 432 bp, Homo sapiens; identical to SEQ ID NO: 444920
  misc_feature: HEFZJCU01EL6TA.11.39.D06.1.454.heavy.3.raw

SEQ ID NO: 451343 - DNA, 396 bp, Homo sapiens; identical to SEQ ID NO: 444469
  misc_feature: HEFZJCU01CLOXG.47.46.E02.1.454.heavy.3.raw

SEQ ID NO: 451344 - DNA, 510 bp, Homo sapiens
  misc_feature: HEFZJCU01DXM42.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctgggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtcgtccg

SEQ ID NO: 451345 - DNA, 490 bp, Homo sapiens; identical to SEQ ID NO: 449963
  misc_feature: HEFZJCU01CIGM0.47.85.H08.1.454.heavy.3.raw

SEQ ID NO: 451346 - DNA, 333 bp, Homo sapiens; identical to SEQ ID NO: 447575
  misc_feature: HEFZJCU01A3QS8.40.81.H04.1.454.heavy.3.raw

SEQ ID NO: 451347 - DNA, 518 bp, Homo sapiens
  misc_feature: HEFZJCU01DUZ2T.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctggctgcctggtcaaggactacttcctagagacacg

SEQ ID NO: 451348 - DNA, 400 bp, Homo sapiens; identical to SEQ ID NO: 444452
  misc_feature: HEFZJCU01BB1LB.47.24.C02.1.454.heavy.3.raw

SEQ ID NO: 451349 - DNA, 497 bp, Homo sapiens; identical to SEQ ID NO: 449468
  misc_feature: HEFZJCU01DJGOF.3.26.C04.1.454.heavy.3.raw

SEQ ID NO: 451350 - DNA, 512 bp, Homo sapiens
  misc_feature: HEFZJCU01D4TS5.40.38.D05.1.454.heavy.3.raw
tctagcgactcacgaccggtgctcgatttagtatctgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtggggagcgtggtaggcct

SEQ ID NO: 451351 - DNA, 512 bp, Homo sapiens
  misc_feature: HEFZJCU01DIM0K.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctgggagtggatctcagggattagtggcactgggcgattatacattattatacagactccgtgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 451352 - DNA, 482 bp, Homo sapiens; identical to SEQ ID NO: 445068
  misc_feature: HEFZJCU01AOX9I.11.23.C01.1.454.heavy.3.raw

SEQ ID NO: 451353 - DNA, 378 bp, Homo sapiens
  misc_feature: HEFZJCU01C2K34.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggtgccctgctccaggagcacctctgggggcacagcggccctgggctgcctggtcaaggactacttcctacgtgagct

SEQ ID NO: 451354 - DNA, 475 bp, Homo sapiens
  misc_feature: HEFZJCU01B7GYF.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctggggcacagcggccctgggctgcctggtcaaggactacttccgagtagtaca

SEQ ID NO: 451355 - DNA, 499 bp, Homo sapiens; identical to SEQ ID NO: 447792
  misc_feature: HEFZJCU01DZBIM.17.10.A10.1.454.heavy.3.raw

SEQ ID NO: 451356 - DNA, 492 bp, Homo sapiens
  misc_feature: HEFZJCU01D1Q2D.13.86.H09.1.454.heavy.3.raw
tcacgtactacacgaccggtgctcgatttagtgctatagacttgggtttggggcacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactaa

SEQ ID NO: 451357 - DNA, 518 bp, Homo sapiens; identical to SEQ ID NO: 451152
  misc_feature: HEFZJCU01DDJO0.13.76.G10.1.454.heavy.3.raw

SEQ ID NO: 451358 - DNA, 498 bp, Homo sapiens
  misc_feature: HEFZJCU01DZHOB.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttactatagagtgacgtacggggcgttcg

SEQ ID NO: 451359 - DNA, 510 bp, Homo sapiens
  misc_feature: HEFZJCU01CQY17.48.81.H04.1.454.heavy.3.raw
agtatacatacacgaccggtgctcgatttagtagtgtagattcgcgggggcatcacatagcaaccacgttcctcccctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacggggcacagcgcagttggacctgagcggcctggagaaccgtgaggacacggccatttactactgtgcgcggggaggtggacggagctcggttttcggagttatcatctactactttg

SEQ ID NO: 451360 - DNA, 372 bp, Homo sapiens
  misc_feature: HEFZJCU01B7YKF.49.30.C08.1.454.heavy.3.raw
agtcgagagacacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactactcctctctcgact

SEQ ID NO: 451361 - DNA, 384 bp, Homo sapiens
  misc_feature: HEFZJCU01EJISB.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttcccctggcgccctgctccaggagcacctccgagagcacagcggccctgggctgcctggtcaaggactacttcccatactcgta

SEQ ID NO: 451362 - DNA, 521 bp, Homo sapiens
  misc_feature: HEFZJCU01CK22R.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccgggctatggttcggacctctgggggccaggggtaaccccg

SEQ ID NO: 451363 - DNA, 382 bp, Homo sapiens
  misc_feature: HEFZJCU01CZG2H.9.53.E09.1.454.heavy.3.raw
tgatacgtctcacgaccggtgctcgatttagagagagtgtgttgggtttgggcgtatttttagcagtggggacaccaactacagcccctccctcaagagtcgagtcaccatgtcagtaggcacgtccaagaaccagatctccctgaagctgacctctgtgaccgccgcggacacggccgtgtattactgtgcgagagttcccaaatatagcaacagctggtacattccttttgatatgtggggccaaggggacaatggtcaccgtctcttcagcctccaccaagggcccatcggtcttccccctggcgccctgctccaggagcacctccgagagcacagcggccctgggctgcctggtcaaggactacttccagacgtatca

SEQ ID NO: 451364 - DNA, 518 bp, Homo sapiens
  misc_feature: HEFZJCU01EC37S.52.33.C11.1.454.heavy.3.raw
cgcagtacgacacgaccggtgctcgatttagagtgagctcgttgggtttggggctgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttcgtggggccg

SEQ ID NO: 451365 - DNA, 499 bp, Homo sapiens
  misc_feature: HEFZJCU01DYL2Z.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgtttggccggtgaactactggggccagggcacctggtcaccgtctcctcagcttccaccaagggccatcggtcttcccctgcgcctgctccaggagcacctctggggcacagcggccctgggctgctgtcaggactactccata

SEQ ID NO: 451366 - DNA, 495 bp, Homo sapiens
  misc_feature: HEFZJCU01DI79G.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctgggtcaccgtctcctcagcctccaccaagggcccatcggtcttcccctggcaccctcctccaagagcacctctgggggcacagcggcctggctgcctggtcaaggactacttccgagtagtaca

SEQ ID NO: 451367 - DNA, 523 bp, Homo sapiens
  misc_feature: HEFZJCU01CLWHG.40.38.D05.1.454.heavy.3.raw
tctagcgactcacgaccggtgctcgatttagtatctgatagttgggtttggggatgctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctcctgaagctgacctctgtgaccgccgcagacacggctgtttattactgtgtgagacgggtgccccaaagaaaaagttgtttatcccgtggggccagggaaccctggtccaccgtctcctcagtcctccaccgaac

SEQ ID NO: 451368 - DNA, 509 bp, Homo sapiens
  misc_feature: HEFZJCU01BUOJ1.14.85.H08.1.454.heavy.3.raw
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggctggtacgctcttgactactgggggccagggaaccctggtcaccgtctcttcagcctccaccaaggg

SEQ ID NO: 451369 - DNA, 525 bp, Homo sapiens
  misc_feature: HEFZJCU01A2IFQ.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgttcatctgagggcagtgttcaatggtatgctgacgccgtgaagggcgattcaccatctccagagacaactccaggaacacaatgtatttggacctgaacagcctaagtcctgaggacgacgggtgtatactactgtacgaaggaggggggaaccgaggcgggagttccaagtactcctttgacgtcgtc

SEQ ID NO: 451370 - DNA, 508 bp, Homo sapiens
  misc_feature: HEFZJCU01AFD9Q.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaactcctccataaacacagcctacatggagttgaggagcctgacatctgacgacacggccgtctattactgtgcgagagtcccagatccggtgacgcctacggcaggccggcctttgactttcgtc

SEQ ID NO: 451371 - DNA, 506 bp, Homo sapiens; identical to SEQ ID NO: 445425
  misc_feature: HEFZJCU01BPXVM.10.38.D05.1.454.heavy.3.raw

SEQ ID NO: 451372 - DNA, 519 bp, Homo sapiens
  misc_feature: HEFZJCU01EWE4I.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttccccctcggccaccctcctccaagagcacctctgggggcacagcggtcccg

SEQ ID NO: 451373 - DNA, 465 bp, Homo sapiens
  misc_feature: HEFZJCU01BAFHB.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 451374 - DNA, 517 bp, Homo sapiens; identical to SEQ ID NO: 450343
  misc_feature: HEFZJCU01CSS1X.2.11.A11.1.454.heavy.3.raw

SEQ ID NO: 451375 - DNA, 511 bp, Homo sapiens
  misc_feature: HEFZJCU01B3W6E.49.6.A06.1.454.heavy.3.raw
agtcgagagacacgaccggtgctcgatttagatctactgacaggggagctctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtgcgaaagttcgcgtgctaggtacatttgactactggggccg

SEQ ID NO: 451376 - DNA, 511 bp, Homo sapiens
  misc_feature: HEFZJCU01D3IPS.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcacgtctccgcagcctccaccaagggccc

SEQ ID NO: 451377 - DNA, 499 bp, Homo sapiens
  misc_feature: HEFZJCU01BYVRG.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaatgaccaacatggacccaatggacagcgcgacatattactgtgcacacattgattgtggtcccaccaggtgtcccgggccctttgatatctggggccgggggacattcgtcaccgtctctgcagcctccacc

SEQ ID NO: 451378 - DNA, 501 bp, Homo sapiens; identical to SEQ ID NO: 448591
  misc_feature: HEFZJCU01CPH5T.13.87.H10.1.454.heavy.3.raw

SEQ ID NO: 451379 - DNA, 513 bp, Homo sapiens
  misc_feature: HEFZJCU01D7Q54.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgataaccggaggggttg

SEQ ID NO: 451380 - DNA, 501 bp, Homo sapiens; identical to SEQ ID NO: 445027
  misc_feature: HEFZJCU01DGL78.26.23.C01.1.454.heavy.3.raw

SEQ ID NO: 451381 - DNA, 501 bp, Homo sapiens
  misc_feature: HEFZJCU01A2WU9.48.41.D08.1.454.heavy.3.raw
agtatacatacacgaccggtgctcgatttagtcacgcgagaaagggaaaggggggagaggagccccagccctgagaatcccaggtgtttccattcagtgatcagcactgaacacagaggactcaccatggagttgggactgagcgtgagtttcctttaggactatttaaaaggtggtcactgtgaacggctactggtggagtctgggggaggcttggtacagcctggcaggtccctgaaactctcctgtgtagcctctggattcaggttgggcgattatgccatgcaatgggtccggcaaggtccaggggaagggcctggagtggggtctcaggcatcgattggaaaagcgagaagattgactatgcggagtctgtgaaggggcgattcatcatctccagagacaacgccaagaactccctgtatttgcagatgaacaatctgagacctgacgacacggccttgattattgtgcaaaagttgtggagtcacagtctctgga

SEQ ID NO: 451382 - DNA, 377 bp, Homo sapiens
  misc_feature: HEFZJCU01DLXXL.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtggggtgactgccccgaatactgggccagggaacccgggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 451383 - DNA, 482 bp, Homo sapiens
  misc_feature: HEFZJCU01BUWUG.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcacctcctccaagagcacctctgggggcacagcggccctgggctgcctggtcaaggactacttccgtatctctcg

SEQ ID NO: 451384 - DNA, 506 bp, Homo sapiens
  misc_feature: HEFZJCU01EPWRG.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgccctgctccaggagcacctctgggggcacagcggccctggctgcctggtcaggactactcccata

SEQ ID NO: 451385 - DNA, 550 bp, Homo sapiens
  misc_feature: HEFZJCU01CCXVO.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacgggggggtactactacgctatggacgtctggggccaagggaccacggtcaccgtctcctcagcctccaccaagggcccatcggtcttcccctggcaccctcctccagagcacctctgggggcacg

SEQ ID NO: 451386 - DNA, 475 bp, Homo sapiens
  misc_feature: HEFZJCU01C6RL4.48.82.H05.1.454.heavy.3.raw
agtatacatacacgaccggtgctcgatttagtcgagctctctcgcgggcacgaccggtgctcgatttagtgacatctcgcagttctttgggttttggggggaagaggaagactgacggtccccccaggagttcaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 451387 - DNA, 528 bp, Homo sapiens
  misc_feature: HEFZJCU01C43DY.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtgggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgacccctggggccggggaacctggtcaccgtctccccaccctccaccg

SEQ ID NO: 451388 - DNA, 535 bp, Homo sapiens
  misc_feature: HEFZJCU01DHK5Q.16.87.H10.1.454.heavy.3.raw
tgtactactccacgaccggtgctcgatttagcagtactgcgttgggtttgggggcccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaacagttatggggttggggggtaggtttggggttttttttttcgttacgtacggga

SEQ ID NO: 451389 - DNA, 390 bp, Homo sapiens; identical to SEQ ID NO: 444541
  misc_feature: HEFZJCU01BMI8F.16.24.C02.1.454.heavy.3.raw

SEQ ID NO: 451390 - DNA, 515 bp, Homo sapiens
  misc_feature: HEFZJCU01COIXT.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagttcggggagttaatataacgacgtatttcgta

SEQ ID NO: 451391 - DNA, 507 bp, Homo sapiens
  misc_feature: HEFZJCU01AH9YX.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaaatagtggaaccatatactatgcagactctgtgaggggccgattcaccatctccagagacaatgccaggaattcactgtatgtggaaatgaacagtctgagagccgaggacacggctctctattactgtgcgagagccccgaaaata

SEQ ID NO: 451392 - DNA, 435 bp, Homo sapiens
  misc_feature: HEFZJCU01EGD95.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaaccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctctgggggcacagcggccctgggctgcctggtcaaggactacttccagtcgctaga

SEQ ID NO: 451393 - DNA, 396 bp, Homo sapiens; identical to SEQ ID NO: 444469
  misc_feature: HEFZJCU01C3VW2.47.46.E02.1.454.heavy.3.raw

SEQ ID NO: 451394 - DNA, 520 bp, Homo sapiens
  misc_feature: HEFZJCU01DMZ51.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagtttggatgtactgggtccgccaagttccagggaaggggctgatgtgggtctcacgtattgatgttgatgggagttacagtgaccacgcggactctgtgaagggccgattcaccgtctccagagaaaacgccaaagaacacggtgtatctgcaaatgactggcctgagagccgaggacacggcagtttattactgtgcaagaggcttggtggtcgactgtcgacctggactggtacttcgatctggtggggcgtggca

SEQ ID NO: 451395 - DNA, 503 bp, Homo sapiens
  misc_feature: HEFZJCU01BIW23.40.31.C09.1.454.heavy.3.raw
tctagcgactcacgaccggtgctcgatttagacgtctcatcaaggaaggaaggggagggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgtcctttgatatgtggggccgagggact

SEQ ID NO: 451396 - DNA, 535 bp, Homo sapiens
  misc_feature: HEFZJCU01ETLZ6.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctagaaagcgtacaactactactactacggtatggacctcgg

SEQ ID NO: 451397 - DNA, 500 bp, Homo sapiens
  misc_feature: HEFZJCU01BMVRR.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctgggggtcccttagactctcctgtgcagcctctggattcactttcagtaacgcctggatgaactgggtccgccaggctccagggaagggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgtt

SEQ ID NO: 451398 - DNA, 512 bp, Homo sapiens
  misc_feature: HEFZJCU01EQP04.48.27.C05.1.454.heavy.3.raw
agtatacatacacgaccggtgctcgatttagacgcgatcgaagggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttacatggttcggggagtctccggacccagcaactggttcgtacccc

SEQ ID NO: 451399 - DNA, 401 bp, Homo sapiens
  misc_feature: HEFZJCU01E1XEO.4.77.G11.1.454.heavy.3.raw
agcactgtagcacgaccggtgctcgatttagctagtcactcaagggaaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctccgacgagcacagcggccctgggctgcctggtcaaggactacttccctacagtgct

SEQ ID NO: 451400 - DNA, 500 bp, Homo sapiens; identical to SEQ ID NO: 444864
  misc_feature: HEFZJCU01D4KR0.9.30.C08.1.454.heavy.3.raw

SEQ ID NO: 451401 - DNA, 477 bp, Homo sapiens; identical to SEQ ID NO: 444659
  misc_feature: HEFZJCU01EG4KT.16.10.A10.1.454.heavy.3.raw

SEQ ID NO: 451402 - DNA, 526 bp, Homo sapiens
  misc_feature: HEFZJCU01CMT4O.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctcctgaaagtgagttctgtgaccgtcgcagacacggctgtctattattgtgcgagacggcaaatatggttcagggtagttcgacttacgtggggccagggaaccctggtccaccgtctcctcagccctccaccaacggg

SEQ ID NO: 451403 - DNA, 482 bp, Homo sapiens
  misc_feature: HEFZJCU01DYUVX.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 451404 - DNA, 511 bp, Homo sapiens
  misc_feature: HEFZJCU01EI10H.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaaccagcgggagttccaagtactctttg

SEQ ID NO: 451405 - DNA, 499 bp, Homo sapiens
  misc_feature: HEFZJCU01EXD3F.53.81.H04.1.454.heavy.3.raw
cgcgtatacacacgaccggtgctcgatttagtagtgtagattcgcgggggctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccattta

SEQ ID NO: 451406 - DNA, 396 bp, Homo sapiens; identical to SEQ ID NO: 444433
  misc_feature: HEFZJCU01C9QO5.47.59.F04.1.454.heavy.3.raw

SEQ ID NO: 451407 - DNA, 378 bp, Homo sapiens
  misc_feature: HEFZJCU01EKWYS.47.46.E02.1.454.heavy.3.raw
agctcacgtacacgaccggtgctcgatttagactcatctacagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 451408 - DNA, 495 bp, Homo sapiens
  misc_feature: HEFZJCU01COSLT.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggttaaggactacttccctacagtgct

SEQ ID NO: 451409 - DNA, 503 bp, Homo sapiens
  misc_feature: HEFZJCU01CF0E2.26.23.C01.1.454.heavy.3.raw
  modified_base (498)..(498): a, c, t, g, unknown or other
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttccccctggccgccctgctccaggagcacctccgagagcacagcggccctgggctgcctggtcaaggactacttccagtanagtct

SEQ ID NO: 451410 - DNA, 482 bp, Homo sapiens; identical to SEQ ID NO: 444503
  misc_feature: HEFZJCU01CJBRN.7.10.A10.1.454.heavy.3.raw

SEQ ID NO: 451411 - DNA, 480 bp, Homo sapiens
  misc_feature: HEFZJCU01A8C7M.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctgtgcgagggagt

SEQ ID NO: 451412 - DNA, 499 bp, Homo sapiens
  misc_feature: HEFZJCU01DD8HM.48.41.D08.1.454.heavy.3.raw
  modified_base (473)..(473): a, c, t, g, unknown or other
agtatacatacacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatntgtggggcaggacaatgtcaccgtct

SEQ ID NO: 451413 - DNA, 512 bp, Homo sapiens
  misc_feature: HEFZJCU01D93UP.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacaccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 451414 - DNA, 475 bp, Homo sapiens
  misc_feature: HEFZJCU01AUNY9.4.14.B03.1.454.heavy.3.raw
agcactgtagcacgaccggtgctcgatttagtgtgagtagttccgcggggatcactcaacaaccacatctgtcctctagagaaaaccctgtgagcacagctcctcaccatggactggacctggaggatcctcttcttggtggcagctgctacaagtgcccactcccaggtgcagctggtgcagtctggggctgaggtgaagaagcctggggcctcagtgaaggtctcctgcaagacttctggatacaccttcaccagttatgatatccactgggtgcgacaggcctctggacaagggcttgagtggatgggatggatgaacccaaacactggtgccacaggctatgcacagaggttccagggcagagtcaccatgaccagggacacctccataaggacagcctacatggagctgagcagcctcagatctgacgacacggccgtgtattactgtgcgaggcgcaagggactaactt

SEQ ID NO: 451415 - DNA, 486 bp, Homo sapiens; identical to SEQ ID NO: 444861
  misc_feature: HEFZJCU01AK0YJ.47.55.E11.1.454.heavy.3.raw

SEQ ID NO: 451416 - DNA, 408 bp, Homo sapiens
  misc_feature: HEFZJCU01B43U9.53.77.G11.1.454.heavy.3.raw
cgcgtatacacacgaccggtgctcgatttagctagtcactcaagggaaggggcttgagtgggtggcgagttaagtgtactaatgatggaagtaataaatattatgcagacttcgtgaagggccgattcaccatctccagagacagttccaaggacatcctgtatctccaaatgaacagcctgagacccgaggacacggctgtctactactgtgcgagggcggggactagatttggtggctacgatcacccccatttttttgacttctggggccagggaaccctggtcaccgtctcctcagcctccaccaagggcccatcggtcttccccctggcaccctcctccaagagcacctctggggcacagcggccctgggctgcctggtcaaggactacttcctcgtactgcg

SEQ ID NO: 451417 - DNA, 514 bp, Homo sapiens
  misc_feature: HEFZJCU01BZT0N.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccac

SEQ ID NO: 451418 - DNA, 523 bp, Homo sapiens
  misc_feature: HEFZJCU01EDPMM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggccg

SEQ ID NO: 451419 - DNA, 498 bp, Homo sapiens
  misc_feature: HEFZJCU01APNSG.53.79.H02.1.454.heavy.3.raw
cgcgtatacacacgaccggtgctcgatttagtgtcacacgaagggaaagggggggagaggagcccagcactagaagtcggcggtgtttccattcggtaatcagcactgaacacagaggactcaccatggagtttgggctgagctgggttttcctcgttgctcttttaagaggtgtccagtgtcaggtgcaactggtggagtctgggggaggcgtggtccagcctggggagtccctgagactctcctgtgaggcgtctggattcaccttcagcaactatgccatgcactgggtccgccaggctccaggcaagggtctggagtgggtgtcagtaatatggtttgattcaagtatacatactatgcagactccgtgcagggccgattcaccatctccagagacaattccaagagcacactgtatctggaaatgaacaatgtgagagtcgaggacacgggtgtctattactgtgcgaaacatcaggcagcagctgggacgtt

SEQ ID NO: 451420 - DNA, 507 bp, Homo sapiens; identical to SEQ ID NO: 446637
  misc_feature: HEFZJCU01E1P05.16.34.D01.1.454.heavy.3.raw

SEQ ID NO: 451421 - DNA, 436 bp, Homo sapiens
  misc_feature: HEFZJCU01C8VQ6.40.27.C05.1.454.heavy.3.raw
tctagcgactcacgaccggtgctcgatttagacgcgatcgaagggtttgggcctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggcccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 451422 - DNA, 483 bp, Homo sapiens; identical to SEQ ID NO: 444639
  misc_feature: HEFZJCU01B6ZK1.11.23.C01.1.454.heavy.3.raw

SEQ ID NO: 451423 - DNA, 502 bp, Homo sapiens
  misc_feature: HEFZJCU01CBL64.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactactccgctacgtaga

SEQ ID NO: 451424 - DNA, 488 bp, Homo sapiens; identical to SEQ ID NO: 445778
  misc_feature: HEFZJCU01CRIV5.18.70.G04.1.454.heavy.3.raw

SEQ ID NO: 451425 - DNA, 515 bp, Homo sapiens
  misc_feature: HEFZJCU01A73FR.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaagggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttatactgtgcaagaggcttgtggtcgactgtcgacctggactggtacttcgatctgtggggcctggc

SEQ ID NO: 451426 - DNA, 490 bp, Homo sapiens
  misc_feature: HEFZJCU01CZEK9.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctggctgcctggtcaaggactacttccgagtgcgtct

SEQ ID NO: 451427 - DNA, 517 bp, Homo sapiens; identical to SEQ ID NO: 446891
  misc_feature: HEFZJCU01CLLR8.17.33.C11.1.454.heavy.3.raw

SEQ ID NO: 451428 - DNA, 478 bp, Homo sapiens
  misc_feature: HEFZJCU01D06FM.14.70.G04.1.454.heavy.3.raw
cgtctagtaccacgaccggtgctcgatttagtgtagtgtgaagggaaagggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctggggcacagcggccctgggctgcctggtcaaggactacttccgtactagacg

SEQ ID NO: 451429 - DNA, 482 bp, Homo sapiens; identical to SEQ ID NO: 444503
  misc_feature: HEFZJCU01BHQ9I.7.10.A10.1.454.heavy.3.raw

SEQ ID NO: 451430 - DNA, 524 bp, Homo sapiens; identical to SEQ ID NO: 445728
  misc_feature: HEFZJCU01AQMGE.5.33.C11.1.454.heavy.3.raw

SEQ ID NO: 451431 - DNA, 469 bp, Homo sapiens
  misc_feature: HEFZJCU01EM1OU.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaaggactacttccctacgtgct

SEQ ID NO: 451432 - DNA, 427 bp, Homo sapiens; identical to SEQ ID NO: 444708
  misc_feature: HEFZJCU01AFKOP.9.34.D01.1.454.heavy.3.raw

SEQ ID NO: 451433 - DNA, 497 bp, Homo sapiens
  misc_feature: HEFZJCU01DWBLG.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcggaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 451434 - DNA, 504 bp, Homo sapiens; identical to SEQ ID NO: 445222
  misc_feature: HEFZJCU01AJR7Q.9.33.C11.1.454.heavy.3.raw

SEQ ID NO: 451435 - DNA, 478 bp, Homo sapiens; identical to SEQ ID NO: 450660
  misc_feature: HEFZJCU01CX7P5.16.10.A10.1.454.heavy.3.raw

SEQ ID NO: 451436 - DNA, 510 bp, Homo sapiens; identical to SEQ ID NO: 449039
  misc_feature: HEFZJCU01A0A5E.7.28.C06.1.454.heavy.3.raw

SEQ ID NO: 451437 - DNA, 512 bp, Homo sapiens
  misc_feature: HEFZJCU01D55Q6.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcgggagtctccgacccagcaactggttcgaccccg

SEQ ID NO: 451438 - DNA, 411 bp, Homo sapiens
  misc_feature: HEFZJCU01CIS5K.51.60.F05.1.454.heavy.3.raw
cgatcgtatacacgaccggtgctcgatttagtacgtcatcagggaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 451439 - DNA, 399 bp, Homo sapiens
  misc_feature: HEFZJCU01A8ZDV.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 451440 - DNA, 497 bp, Homo sapiens
  misc_feature: HEFZJCU01D6LXZ.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactgggg

SEQ ID NO: 451441 - DNA, 492 bp, Homo sapiens; identical to SEQ ID NO: 444827
  misc_feature: HEFZJCU01D6VMJ.4.28.C06.1.454.heavy.3.raw

SEQ ID NO: 451442 - DNA, 385 bp, Homo sapiens; identical to SEQ ID NO: 444438
  misc_feature: HEFZJCU01EMZBQ.18.60.F05.1.454.heavy.3.raw

SEQ ID NO: 451443 - DNA, 505 bp, Homo sapiens
  misc_feature: HEFZJCU01EVLLU.4.25.C03.1.454.heavy.3.raw
agcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctcagagacaattccaacaacacgctgtttctgacaaatgaacagcctagagagccgaggacacggctgtgtatcactgtgtcagagatgccggagggtccggttaccccg

SEQ ID NO: 451444 - DNA, 392 bp, Homo sapiens
  misc_feature: HEFZJCU01DXIA4.19.79.H02.1.454.heavy.3.raw
tactctcgtgcacgaccggtgctcgatttagtgtcacacgaagggaaggggctggagtgggtgtcaacgattagtggaagtggtactggtatatactacgcagactccgtgaagggccggttcaccctctccagagacaattccaagaatacggtgtatctgcaaatgaacagcctgagagccgaggacacggccgtatattactgtgcgaatcaaaagttcggggacgtccgattcgatatggacgtctggggccaagggaccacggtcaccgtctcctcagcctccaccaagggcccatcggtcttccccctggcgccctgctccaggagcacctccgagagcacagcggccctgggctgcctggtcaaggactacttcccacgagagta

SEQ ID NO: 451445 - DNA, 477 bp, Homo sapiens
  misc_feature: HEFZJCU01ENY0V.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaagcttggtcaccgtctcctcagcctccaccaagggcccatcggtcttcccctcggcaccctcctccaagagcacctctgggggcacagcggccctgggctgcctggtcaaggactacttccgagtagtaca

SEQ ID NO: 451446 - DNA, 495 bp, Homo sapiens; identical to SEQ ID NO: 446949
  misc_feature: HEFZJCU01AOJUK.16.37.D04.1.454.heavy.3.raw

SEQ ID NO: 451447 - DNA, 520 bp, Homo sapiens; identical to SEQ ID NO: 448947
  misc_feature: HEFZJCU01DO1GS.12.40.D07.1.454.heavy.3.raw

SEQ ID NO: 451448 - DNA, 508 bp, Homo sapiens
  misc_feature: HEFZJCU01ERXJ9.14.85.H08.1.454.heavy.3.raw
cgtctagtaccacgaccggtgctcgatttagtatcactcagtcgcgggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccagcccccagggaaggggctggagtggattggggaaatcagtcaaagtggaggcaccaagtacaacccgtccctcgagagtcgagtcaccatatcaatagacacgttccagaatcagttctccctgaggctgacttctgtgacagccgcggacacggctgtgtattactgtgcgagatctttcggctggtacgctcttgactactggggccagggaaccctggtcaccgtctcttcagcctccaccaaggg

SEQ ID NO: 451449 - DNA, 320 bp, Homo sapiens
  misc_feature: HEFZJCU01CXQHX.48.15.B04.1.454.heavy.3.raw
agtatacatacacgaccggtgctcgatttagacagtatatatccgcgggggaccggccggttcaccatctacagagacaacggcaagaagtcgctgtttctgcaaatgaacagcctgacctccgacgacacggctctctattattgtgtgagagaatcctggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatact

SEQ ID NO: 451450 - DNA, 515 bp, Homo sapiens
  misc_feature: HEFZJCU01B113L.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggatattactttgacaactggggccagggaaccctggtcaccgtctcctcagcctccaccaagggcccatcggtcttcccctggccgccctgctccaggacgcacctccgagagcacagcgccctgggcctgcctggtcaacggactacgtt

SEQ ID NO: 451451 - DNA, 404 bp, Homo sapiens; identical to SEQ ID NO: 448165
  misc_feature: HEFZJCU01A49BY.51.52.E08.1.454.heavy.3.raw

SEQ ID NO: 451452 - DNA, 525 bp, Homo sapiens
  misc_feature: HEFZJCU01D7EJO.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatccggtcttccccctggccaccctcctccaagagcacctctgggggcacagcc

SEQ ID NO: 451453 - DNA, 489 bp, Homo sapiens; identical to SEQ ID NO: 444791
  misc_feature: HEFZJCU01DH0FP.47.85.H08.1.454.heavy.3.raw

SEQ ID NO: 451454 - DNA, 379 bp, Homo sapiens; identical to SEQ ID NO: 444450
  misc_feature: HEFZJCU01BUG3A.47.77.G11.1.454.heavy.3.raw

SEQ ID NO: 451455 - DNA, 529 bp, Homo sapiens
  misc_feature: HEFZJCU01CUU3P.12.40.D07.1.454.heavy.3.raw
atacgacgtacacgaccggtgctcgatttagtgatagagcgtaacaacagagggctcaccatggagtttgggctgagctgggttttcctcgttgctctttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcttcaaatagacagcctgagaccagacgacacggctgtctattattgcgcgagagagacacacgaacctactggccaatactatgggggcttgttctgggggccagggggaccctggtcatcgtctccccagcctccaccaagggcccatcggtcttcccctggcgccctg

SEQ ID NO: 451456 - DNA, 510 bp, Homo sapiens
  misc_feature: HEFZJCU01DTBTQ.48.26.C04.1.454.heavy.3.raw
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtatactgtgcgagagaagggttttactatggttcgggagtctccgacccagcaactggttcgacccc

SEQ ID NO: 451457 - DNA, 506 bp, Homo sapiens; identical to SEQ ID NO: 446520
  misc_feature: HEFZJCU01CO46B.10.38.D05.1.454.heavy.3.raw

SEQ ID NO: 451458 - DNA, 508 bp, Homo sapiens
  misc_feature: HEFZJCU01A15PD.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacaccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 451459 - DNA, 396 bp, Homo sapiens; identical to SEQ ID NO: 444426
  misc_feature: HEFZJCU01CJBTI.18.31.C09.1.454.heavy.3.raw

SEQ ID NO: 451460 - DNA, 517 bp, Homo sapiens
  misc_feature: HEFZJCU01C2ZRJ.16.21.B10.1.454.heavy.3.raw
  modified_base (383)..(383): a, c, t, g, unknown or other
  modified_base (437)..(437): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctgggggggtccctgagactctcctgtgcagcctctggattcacctttgacagctatgccatgacctgggtccgccaggctcagggaaggggctggaatgggtctcaggtattactgggtggtggttataccacatactacgcaagactccgtgaagggccggttcaccntctccagagacaattccaagaacacactgtatctgcaaatgaaacagcctgagngccgacgacacggccatatattactgtgcgaaagcaaccggcagttagtcacccatacctactttgaactactggggccg

SEQ ID NO: 451461 - DNA, 505 bp, Homo sapiens
  misc_feature: HEFZJCU01EX2L2.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacgaccacctattattgtgcgcgacatgactacgctcaattctggggccagggacg

SEQ ID NO: 451462 - DNA, 508 bp, Homo sapiens
  misc_feature: HEFZJCU01CJHTY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaactgggtgcgccaggccgctggacaacgacctgagtggatgggatgggcgaaccctaacactgatgtcacagtgtcttcacccatccctccgggacagacttaccatgaccacgaactcctccataaacacagcctacatggagttgaggagcctgacatctgacgacacggccgtctattactgtgcgagacgtcccagactccggtgagcctacggcaggcggtcctttgactttc

SEQ ID NO: 451463 - DNA, 523 bp, Homo sapiens
  misc_feature: HEFZJCU01BJ44N.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactgggggccgggggagccccggtcatcgtctcctcagcctccaccaagggcccatcggtcttcccctggcaccctcctcc

SEQ ID NO: 451464 - DNA, 379 bp, Homo sapiens; identical to SEQ ID NO: 444450
  misc_feature: HEFZJCU01AXLZW.47.77.G11.1.454.heavy.3.raw

SEQ ID NO: 451465 - DNA, 409 bp, Homo sapiens
  misc_feature: HEFZJCU01DIFBW.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccataggtcttccccctggcgccctgctccaggagcacctctgggggcacagcggccctgggctgcctggtcaaggactacttccgagtgcgtct

SEQ ID NO: 451466 - DNA, 517 bp, Homo sapiens; identical to SEQ ID NO: 446078
  misc_feature: HEFZJCU01DZ7JY.9.34.D01.1.454.heavy.3.raw

SEQ ID NO: 451467 - DNA, 525 bp, Homo sapiens
  misc_feature: HEFZJCU01EAGXF.15.87.H10.1.454.heavy.3.raw
tctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccagggtttccctacggcatggacgtcg

SEQ ID NO: 451468 - DNA, 516 bp, Homo sapiens
  misc_feature: HEFZJCU01AMQ7P.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctggctgcctgtcaaggactacttccagacgtatca

SEQ ID NO: 451469 - DNA, 535 bp, Homo sapiens
  misc_feature: HEFZJCU01B64ED.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaattgggagggcctttcatgtctggggccaagggacgctggtcaccgtctcttcagcctccaccaagggcccatcggtcttcccctggcaccctcctccaagagcacctctgggggcacagcc

SEQ ID NO: 451470 - DNA, 528 bp, Homo sapiens
  misc_feature: HEFZJCU01CNVVA.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatgggggcccacgaacgttactacgctatggacgtctggggccgaagggaccac

SEQ ID NO: 451471 - DNA, 501 bp, Homo sapiens; identical to SEQ ID NO: 447123
  misc_feature: HEFZJCU01BEK8W.3.20.B09.1.454.heavy.3.raw

SEQ ID NO: 451472 - DNA, 492 bp, Homo sapiens; identical to SEQ ID NO: 446706
  misc_feature: HEFZJCU01ESZ5C.11.71.G05.1.454.heavy.3.raw

SEQ ID NO: 451473 - DNA, 501 bp, Homo sapiens
  misc_feature: HEFZJCU01D4EPI.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggaccacggctgtgtattactgtgacgaaagatttcataggaggtgacgtac

SEQ ID NO: 451474 - DNA, 517 bp, Homo sapiens
  misc_feature: HEFZJCU01CS8X4.49.81.H04.1.454.heavy.3.raw
agtcgagagacacgaccggtgctcgatttagtagtgtagattcgcggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtgaccccgtccactcggtacggacg

SEQ ID NO: 451475 - DNA, 520 bp, Homo sapiens
  misc_feature: HEFZJCU01AQ8FW.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggttccttttgaccaggtggggccagggaaccctggtcaccgtctcctcagcttccaccaagggcccatcggtccttcccctggcgccctgctccaggagcacctcgtgggggcacagccggtccc

SEQ ID NO: 451476 - DNA, 502 bp, Homo sapiens
  misc_feature: HEFZJCU01DBQBS.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgatgacacggctgtatattactgtgcgagagatatgagaaactcaatgatagaaatcagggatgggggccagggaaccctggtcaccgtctcctcagcctccaccaagggcccatcggtcttccccctggcgccctgctccaggagcacctccgagagcacagcggccctggggctgcctggtcaaggactacttccga

SEQ ID NO: 451477 - DNA, 517 bp, Homo sapiens; identical to SEQ ID NO: 448282
  misc_feature: HEFZJCU01D40IV.13.76.G10.1.454.heavy.3.raw

SEQ ID NO: 451478 - DNA, 497 bp, Homo sapiens
  misc_feature: HEFZJCU01BT9NG.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctccgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaccaggtggtccttacaatgaccaacatggaccctgtggacacagccacatattactgtgcacagagatacgggcagcacgtggtttggggctactggggccagggaaccctggtcaccgtctcctcagcctccaccaac

SEQ ID NO: 451479 - DNA, 418 bp, Homo sapiens
  misc_feature: HEFZJCU01EDJAX.16.28.C06.1.454.heavy.3.raw
tgtactactccacgaccggtgctcgatttagagctcacgtattgggtttgggattgtctctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccaagggcccactcggtcttccccctggcgccctgctccaggagcacctccgagaacacagcggccctgggctgcctggtcaaggactacttccgagtagtaca

SEQ ID NO: 451480 - DNA, 518 bp, Homo sapiens; identical to SEQ ID NO: 444718
  misc_feature: HEFZJCU01AF2YI.9.34.D01.1.454.heavy.3.raw

SEQ ID NO: 451481 - DNA, 511 bp, Homo sapiens
  misc_feature: HEFZJCU01BE05I.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctgggg

SEQ ID NO: 451482 - DNA, 500 bp, Homo sapiens
  misc_feature: HEFZJCU01BO759.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagatccaaccccttacgattttggagtt

SEQ ID NO: 451483 - DNA, 463 bp, Homo sapiens; identical to SEQ ID NO: 446208
  misc_feature: HEFZJCU01BYPQ4.19.10.A10.1.454.heavy.3.raw

SEQ ID NO: 451484 - DNA, 511 bp, Homo sapiens
  misc_feature: HEFZJCU01DOOFB.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggctacttccgagtgcgtct

SEQ ID NO: 451485 - DNA, 535 bp, Homo sapiens
  misc_feature: HEFZJCU01CKEU8.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccgggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattgggggccagggaaccctggtctccgtctcgtcag

SEQ ID NO: 451486 - DNA, 498 bp, Homo sapiens
  misc_feature: HEFZJCU01AP0IY.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttggggtgtt

SEQ ID NO: 451487 - DNA, 518 bp, Homo sapiens; identical to SEQ ID NO: 444718
  misc_feature: HEFZJCU01B7OY0.9.34.D01.1.454.heavy.3.raw

SEQ ID NO: 451488 - DNA, 489 bp, Homo sapiens
  misc_feature: HEFZJCU01CCUNK.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacgggtcaccgtctcctcggcctccaccaagggcccatcggtcttcccctgcgccctgctccacggagcacctccgagagcacagcggccctgggctgcctggtcaggactacttcccatactcgta

SEQ ID NO: 451489 - DNA, 497 bp, Homo sapiens
  misc_feature: HEFZJCU01BLNHA.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgaccctggggccagggaaccctagtcaccgtctcctcagcctccaccaagggcccatcggtcttcccctgcgccctgctccaggagcacctccgag

SEQ ID NO: 451490 - DNA, 498 bp, Homo sapiens
  misc_feature: HEFZJCU01A0TIT.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcacgcctccacc

SEQ ID NO: 451491 - DNA, 514 bp, Homo sapiens
  misc_feature: HEFZJCU01DT4QV.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcactatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggcccg

SEQ ID NO: 451492 - DNA, 517 bp, Homo sapiens
  misc_feature: HEFZJCU01ENCGZ.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacgggccatatattactgtgcgaaagcaccgggcagttagtcacccatacctactttgacttactgggggtaccg

SEQ ID NO: 451493 - DNA, 516 bp, Homo sapiens
  misc_feature: HEFZJCU01BBYVM.13.71.G05.1.454.heavy.3.raw
tcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcaaaatacgcatactacggtaattcaccggcttactactacaacggtatggacgtctggggccaagggaccacggtcaccgtctcctcagcctccaccaaggcccatcggtctcccctggc

SEQ ID NO: 451494 - DNA, 484 bp, Homo sapiens
  misc_feature: HEFZJCU01CF9FB.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagacggcccccatagacatgccacctcgtctctggtgct

SEQ ID NO: 451495 - DNA, 535 bp, Homo sapiens
  misc_feature: HEFZJCU01ER4IM.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtctcccctggcaccctcctccagagcacctctggggcacagcc

SEQ ID NO: 451496 - DNA, 513 bp, Homo sapiens
  misc_feature: HEFZJCU01DD13Q.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggagggctggagtgcgtctctttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaaccgttactaccgctatggacgtcgtggggccaac

SEQ ID NO: 451497 - DNA, 530 bp, Homo sapiens
  misc_feature: HEFZJCU01EBPTZ.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacagtggcagctccaagtactactttagacttctgggccagggaaccctggtcaccgtctcctcagcctccaccaaggcccactcggtcttcccctggcgccctgctccaggagcacctccgacgacg

SEQ ID NO: 451498 - DNA, 410 bp, Homo sapiens
  misc_feature: HEFZJCU01EG8SM.13.61.F06.1.454.heavy.3.raw
tcacgtactacacgaccggtgctcgatttagctacgctctaagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttccccctggcgccctgctccaggagcacctctgggggcacagcggccctgggctgcctggtcaaggactacttcctagtacgtga

SEQ ID NO: 451499 - DNA, 506 bp, Homo sapiens
  misc_feature: HEFZJCU01CBB7M.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggccatcggtcttcccctggccaccctcctccaagagcacctctgggggcacagcggccctgggctgcctggtcaaggactacttccgagtagtaca

SEQ ID NO: 451500 - DNA, 409 bp, Homo sapiens
  misc_feature: HEFZJCU01BFESA.19.12.B01.1.454.heavy.3.raw
tactctcgtgcacgaccggtgctcgatttagtagtgtagatttgggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagta

SEQ ID NO: 451501 - DNA, 529 bp, Homo sapiens
  misc_feature: HEFZJCU01CW95Q.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctctcagcctccaccaagg

SEQ ID NO: 451502 - DNA, 525 bp, Homo sapiens
  misc_feature: HEFZJCU01EWEAI.52.57.F02.1.454.heavy.3.raw
cgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtcgtgggccaagggaccacggtcaccgtcgcctcagcctccaccaagggcccatcggtcttcccctggcaccctcctccaagagcacctctgggggcacagcggccctgggctgcctggtcaaggactacttcctatacgatcg

SEQ ID NO: 451503 - DNA, 498 bp, Homo sapiens
  misc_feature: HEFZJCU01CQ10J.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggactt

SEQ ID NO: 451504 - DNA, 517 bp, Homo sapiens; identical to SEQ ID NO: 446891
  misc_feature: HEFZJCU01EU610.17.33.C11.1.454.heavy.3.raw

SEQ ID NO: 451505 - DNA, 518 bp, Homo sapiens; identical to SEQ ID NO: 444718
  misc_feature: HEFZJCU01BWM8H.9.34.D01.1.454.heavy.3.raw

SEQ ID NO: 451506 - DNA, 513 bp, Homo sapiens
  misc_feature: HEFZJCU01EGD71.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccagggg

SEQ ID NO: 451507 - DNA, 529 bp, Homo sapiens
  misc_feature: HEFZJCU01C8GFC.14.35.D02.1.454.heavy.3.raw
  modified_base (465)..(465): a, c, t, g, unknown or other
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctcggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactgggccagggaaccctggtcaccgtctcctcagcctccaccaagggcccatcggtcttccccctcggcnccctcctccaagagcacctctgggggcacagcggcctgggctgcctggtcaaggactacttccg

SEQ ID NO: 451508 - DNA, 510 bp, Homo sapiens
  misc_feature: HEFZJCU01CM2TC.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctgggggcacagcggccctgggctgcctggtcaggactacttccgtactacg

SEQ ID NO: 451509 - DNA, 513 bp, Homo sapiens; identical to SEQ ID NO: 446452
  misc_feature: HEFZJCU01CMSYU.17.33.C11.1.454.heavy.3.raw

SEQ ID NO: 451510 - DNA, 506 bp, Homo sapiens
  misc_feature: HEFZJCU01B933U.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttc

SEQ ID NO: 451511 - DNA, 504 bp, Homo sapiens; identical to SEQ ID NO: 445222
  misc_feature: HEFZJCU01EI5EK.9.33.C11.1.454.heavy.3.raw

SEQ ID NO: 451512 - DNA, 514 bp, Homo sapiens
  misc_feature: HEFZJCU01EMXHG.48.34.D01.1.454.heavy.3.raw
agtatacatacacgaccggtgctcgatttagatcgtctgtgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctcc

SEQ ID NO: 451513 - DNA, 509 bp, Homo sapiens; identical to SEQ ID NO: 450073
  misc_feature: HEFZJCU01DDDQS.16.21.B10.1.454.heavy.3.raw

SEQ ID NO: 451514 - DNA, 506 bp, Homo sapiens; identical to SEQ ID NO: 445682
  misc_feature: HEFZJCU01DATVU.48.44.D11.1.454.heavy.3.raw

SEQ ID NO: 451515 - DNA, 519 bp, Homo sapiens
  misc_feature: HEFZJCU01CTJ53.52.20.B09.1.454.heavy.3.raw
cgcagtacgacacgaccggtgctcgatttagtgtagtgtgaaggggggaagaggaagactgacggtcccccaggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgtgcgccaggaagcagtggctggccacatgatgcttttgatatctggagccaagggacaatggtcatcgtctcttcggcctccaccaagggcccagtcgcttccccg

SEQ ID NO: 451516 - DNA, 500 bp, Homo sapiens; identical to SEQ ID NO: 446062
  misc_feature: HEFZJCU01EO1MP.12.38.D05.1.454.heavy.3.raw

SEQ ID NO: 451517 - DNA, 393 bp, Homo sapiens; identical to SEQ ID NO: 444509
  misc_feature: HEFZJCU01EDBK1.49.46.E02.1.454.heavy.3.raw

SEQ ID NO: 451518 - DNA, 505 bp, Homo sapiens
  misc_feature: HEFZJCU01DSZ2W.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctcagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 451519 - DNA, 480 bp, Homo sapiens
  misc_feature: HEFZJCU01BFNHX.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaagtttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttgacgtctggggccaagggaccacggtcatcgtctcctcagcctccaccaagggcccatcggtcttcccctggcaccctcctccaagagcacctctggggcacagcggccctgggctgcctggtcaaggactactccgtatctctcg

SEQ ID NO: 451520 - DNA, 549 bp, Homo sapiens
  misc_feature: HEFZJCU01BDZSQ.21.46.E02.1.454.heavy.3.raw
tcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctgggccagggaaccctggtaaccgtctcctcagcctccaccaagggcccatcggtcttccccctggcgccctgctccaggagcacctccgagagcacagcggcccgtgggctgcctggtcaaggactacttcccgacg

SEQ ID NO: 451521 - DNA, 536 bp, Homo sapiens
  misc_feature: HEFZJCU01C5HF6.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgagggacacggctctgtattactgtgcgaggatacctcctctggcgggccaggttcctacggcatggacgtctggggccaagggaccacggtcaccgtctcctcagcctccaccaagggcccatcggtcttcccctggcaccctcctccaagagcacctctgggggcacagcggccctgggctgcctggtc

SEQ ID NO: 451522 - DNA, 409 bp, Homo sapiens; identical to SEQ ID NO: 444519
  misc_feature: HEFZJCU01BMVUK.3.41.D08.1.454.heavy.3.raw

SEQ ID NO: 451523 - DNA, 490 bp, Homo sapiens; identical to SEQ ID NO: 448082
  misc_feature: HEFZJCU01BC3LZ.47.85.H08.1.454.heavy.3.raw

SEQ ID NO: 451524 - DNA, 520 bp, Homo sapiens
  misc_feature: HEFZJCU01EP0BV.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgaagtctatgatacccaatttgggaggggcctttcat

SEQ ID NO: 451525 - DNA, 470 bp, Homo sapiens; identical to SEQ ID NO: 444866
  misc_feature: HEFZJCU01AM4JE.4.36.D03.1.454.heavy.3.raw

SEQ ID NO: 451526 - DNA, 503 bp, Homo sapiens; identical to SEQ ID NO: 445995
  misc_feature: HEFZJCU01EPUBS.17.25.C03.1.454.heavy.3.raw

SEQ ID NO: 451527 - DNA, 520 bp, Homo sapiens; identical to SEQ ID NO: 446725
  misc_feature: HEFZJCU01CO9K6.12.86.H09.1.454.heavy.3.raw

SEQ ID NO: 451528 - DNA, 511 bp, Homo sapiens
  misc_feature: HEFZJCU01B0BBM.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaaggcccatcggtcttcccctggcaccctcctccaagagcacctctgggggcacagcggccctgggctgcctggtcaaggactacttccgagtgcgtct

SEQ ID NO: 451529 - DNA, 517 bp, Homo sapiens; identical to SEQ ID NO: 446891
  misc_feature: HEFZJCU01D4H75.17.33.C11.1.454.heavy.3.raw

SEQ ID NO: 451530 - DNA, 514 bp, Homo sapiens
  misc_feature: HEFZJCU01BYQQU.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggaccg

SEQ ID NO: 451531 - DNA, 373 bp, Homo sapiens
  misc_feature: HEFZJCU01BFN22.5.23.C01.1.454.heavy.3.raw
atcagacacgcacgaccggtgctcgatttagtacacgtgattagggattggggagtatctatcatactgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 451532 - DNA, 378 bp, Homo sapiens
  misc_feature: HEFZJCU01DT131.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 451533 - DNA, 503 bp, Homo sapiens
  misc_feature: HEFZJCU01BDYZP.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtgaaatgaacagtctgagagccgaggacacggctctctattactgtgcgagagccccgaaatagggtactacg

SEQ ID NO: 451534 - DNA, 508 bp, Homo sapiens
  misc_feature: HEFZJCU01EDATE.48.53.E09.1.454.heavy.3.raw
agtatacatacacgaccggtgctcgatttagagagagtgtgttgggtttgggcacgaccggtgctcgatttagatcgtctgtgttgggaggtgtggtccagcctgggaagtccctgacactgtcctgcgcagcctctggattcaccttcaccaccttttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactgggccgagggaaccctggtcaccgtctcctcagcctccaccaagggcccatcggtcttcccctggcgccctgctccaggagcacctccgagagcacagccggccc

SEQ ID NO: 451535 - DNA, 500 bp, Homo sapiens
  misc_feature: HEFZJCU01CIJB5.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagattttggagtggttattatacctttga

SEQ ID NO: 451536 - DNA, 510 bp, Homo sapiens
  misc_feature: HEFZJCU01CKGZP.4.26.C04.1.454.heavy.3.raw
agcactgtagcacgaccggtgctcgatttagtctagcgactttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaagggctggagtgggtctcagcaattagtggaggtggtggtggtggtacatactacgcaaactccgtgaggggccgattcaccatctccagagacaattccaagaacacgttatatctgcaatgaacagcctgcgagccgacgacacggccgtatattactgtgcgaaatgccttattgcgaccgagcgtagcta

SEQ ID NO: 451537 - DNA, 521 bp, Homo sapiens
  misc_feature: HEFZJCU01D85MP.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaaatgaacagcctgagagccgatgacacggccgtgtattactgtgcgagagatggggcccacgaacgttactacgctatggacgtcgtggggccaagggaccg

SEQ ID NO: 451538 - DNA, 493 bp, Homo sapiens
  misc_feature: HEFZJCU01BRKT9.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 451539 - DNA, 412 bp, Homo sapiens; identical to SEQ ID NO: 447181
  misc_feature: HEFZJCU01BSM91.51.60.F05.1.454.heavy.3.raw

SEQ ID NO: 451540 - DNA, 515 bp, Homo sapiens
  misc_feature: HEFZJCU01B74DI.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacgtctggacgtctgggccaggggaccaa

SEQ ID NO: 451541 - DNA, 400 bp, Homo sapiens; identical to SEQ ID NO: 444452
  misc_feature: HEFZJCU01CYPZG.47.24.C02.1.454.heavy.3.raw

SEQ ID NO: 451542 - DNA, 335 bp, Homo sapiens; identical to SEQ ID NO: 444488
  misc_feature: HEFZJCU01B8405.51.45.E01.1.454.heavy.3.raw

SEQ ID NO: 451543 - DNA, 516 bp, Homo sapiens
  misc_feature: HEFZJCU01A20NA.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccctggggcccgggaaccctggtcaccgtctcctcagcctccaccaagggcccatcggtcttccccctggccaccctcctccaagagcacctctgggggcacagcggccctgggctgcctggtcaaggactacttcc

SEQ ID NO: 451544 - DNA, 507 bp, Homo sapiens; identical to SEQ ID NO: 446637
  misc_feature: HEFZJCU01C0LXL.16.34.D01.1.454.heavy.3.raw

SEQ ID NO: 451545 - DNA, 510 bp, Homo sapiens
  misc_feature: HEFZJCU01BYCOF.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggaaccct

SEQ ID NO: 451546 - DNA, 499 bp, Homo sapiens
  misc_feature: HEFZJCU01EM989.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgacaatttgataggctctatgactggacttctc

SEQ ID NO: 451547 - DNA, 414 bp, Homo sapiens; identical to SEQ ID NO: 444901
  misc_feature: HEFZJCU01COGOB.51.70.G04.1.454.heavy.3.raw

SEQ ID NO: 451548 - DNA, 523 bp, Homo sapiens
  misc_feature: HEFZJCU01CH3OA.53.58.F03.1.454.heavy.3.raw
cgcgtatacacacgaccggtgctcgatttagtctgatcgagaagggaaaggggatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctgttggctccatcattcattatttctggagctgggtccggcagcccccagggaagggactggagtggattgggtatggtctattacaccgggaccacccactacaacccctccctcaagagtcgagtcaccatatcagtagacacgtccaggaaccagttctccctgaagctgagctctgcgaccgctgcggacacggccgtgtattattgtgcgagagttagatttgatactggtgcagccgtacgggggtcctggttcgacccctggggccagtggaaccctggtcaccgtctcctcagt

SEQ ID NO: 451549 - DNA, 491 bp, Homo sapiens
  misc_feature: HEFZJCU01A9VQW.49.17.B06.1.454.heavy.3.raw
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttactgtgcgccaggaagcagtggctggccg

SEQ ID NO: 451550 - DNA, 494 bp, Homo sapiens
  misc_feature: HEFZJCU01D7NKL.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaggactacttccctacagtgct

SEQ ID NO: 451551 - DNA, 463 bp, Homo sapiens; identical to SEQ ID NO: 446208
  misc_feature: HEFZJCU01ADJ8L.19.10.A10.1.454.heavy.3.raw

SEQ ID NO: 451552 - DNA, 509 bp, Homo sapiens; identical to SEQ ID NO: 444586
  misc_feature: HEFZJCU01CDSQV.12.78.H01.1.454.heavy.3.raw

SEQ ID NO: 451553 - DNA, 508 bp, Homo sapiens
  misc_feature: HEFZJCU01ENC1L.7.71.G05.1.454.heavy.3.raw
cgtgtctctacacgaccggtgctcgatttagtgtcgtcgcaagagagagggggagctctgagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttcc

SEQ ID NO: 451554 - DNA, 449 bp, Homo sapiens
  misc_feature: HEFZJCU01CWCOZ.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctgggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 451555 - DNA, 418 bp, Homo sapiens; identical to SEQ ID NO: 446028
  misc_feature: HEFZJCU01B66VE.16.28.C06.1.454.heavy.3.raw

SEQ ID NO: 451556 - DNA, 518 bp, Homo sapiens
  misc_feature: HEFZJCU01BP9TA.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggaccg

SEQ ID NO: 451557 - DNA, 511 bp, Homo sapiens
  misc_feature: HEFZJCU01BR1HP.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactacttcccatac

SEQ ID NO: 451558 - DNA, 536 bp, Homo sapiens
  misc_feature: HEFZJCU01D5SG4.49.28.C06.1.454.heavy.3.raw
agtcgagagacacgaccggtgctcgatttagagctcacgtattgggtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagacttttatgacagtagtggtttctccgagtatgcacattacggcatggacgtctggggccaagggaccccggtcaccgtctccttagcctccaccaaggcccatcggtcttccccctggccaccctcctccaagagcacctctc

SEQ ID NO: 451559 - DNA, 422 bp, Homo sapiens; identical to SEQ ID NO: 444681
  misc_feature: HEFZJCU01BABAK.16.78.H01.1.454.heavy.3.raw

SEQ ID NO: 451560 - DNA, 379 bp, Homo sapiens
  misc_feature: HEFZJCU01B7J41.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcaccgtctgggggcacagcggccctgggctgcctggtcaaggactacttcctacgtgagct

SEQ ID NO: 451561 - DNA, 485 bp, Homo sapiens
  misc_feature: HEFZJCU01B7NAF.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaaggcccatcggtcttcccctggcgccctgctccaggagcacctccgagagcacagcggccctgggctgcctggtcaaggactacttcctacgtgagct

SEQ ID NO: 451562 - DNA, 519 bp, Homo sapiens; identical to SEQ ID NO: 445330
  misc_feature: HEFZJCU01C6E1I.7.78.H01.1.454.heavy.3.raw

SEQ ID NO: 451563 - DNA, 526 bp, Homo sapiens; identical to SEQ ID NO: 446836
  misc_feature: HEFZJCU01EAK2X.11.25.C03.1.454.heavy.3.raw

SEQ ID NO: 451564 - DNA, 532 bp, Homo sapiens; identical to SEQ ID NO: 445228
  misc_feature: HEFZJCU01CIWU8.7.78.H01.1.454.heavy.3.raw

SEQ ID NO: 451565 - DNA, 483 bp, Homo sapiens; identical to SEQ ID NO: 448406
  misc_feature: HEFZJCU01BSXO2.11.23.C01.1.454.heavy.3.raw

SEQ ID NO: 451566 - DNA, 521 bp, Homo sapiens; identical to SEQ ID NO: 447186
  misc_feature: HEFZJCU01AEB0M.3.55.E11.1.454.heavy.3.raw

SEQ ID NO: 451567 - DNA, 491 bp, Homo sapiens; identical to SEQ ID NO: 445333
  misc_feature: HEFZJCU01BRLV6.19.53.E09.1.454.heavy.3.raw

SEQ ID NO: 451568 - DNA, 482 bp, Homo sapiens; identical to SEQ ID NO: 444503
  misc_feature: HEFZJCU01EKQC1.7.10.A10.1.454.heavy.3.raw

SEQ ID NO: 451569 - DNA, 537 bp, Homo sapiens
  misc_feature: HEFZJCU01D9G2Q.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctaggaaatgaacaatctgagagtcgacgatacggctgtctatcattgttgttttcgagttcgcccgtttcggtcccggaccgggtacctttcgtcgggggtcccaacggggtaaccccg

SEQ ID NO: 451570 - DNA, 499 bp, Homo sapiens
  misc_feature: HEFZJCU01EK55D.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgagttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggcca

SEQ ID NO: 451571 - DNA, 492 bp, Homo sapiens; identical to SEQ ID NO: 446150
  misc_feature: HEFZJCU01AD9EN.4.57.F02.1.454.heavy.3.raw

SEQ ID NO: 451572 - DNA, 502 bp, Homo sapiens
  misc_feature: HEFZJCU01ESSFN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttc

SEQ ID NO: 451573 - DNA, 516 bp, Homo sapiens
  misc_feature: HEFZJCU01EEUJX.46.67.G01.1.454.heavy.3.raw
actagcagtacacgaccggtgctcgatttagagtatacatattgggtttggggatgctttctgagagtcatggatctcatgtgcaagaaagtgaagcacctgtggttcttcctcctgctggtggcggctcccagatgggtcctatccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagtttccctgacgctgacgtctgtgaccgccgcagacacggctgtctattattgtgcgagactagccttctgtagtgggggtacttgcaacccgggatactactccaccttcggcttggacatctggggccgac

SEQ ID NO: 451574 - DNA, 491 bp, Homo sapiens; identical to SEQ ID NO: 445531
  misc_feature: HEFZJCU01AR09Z.11.38.D05.1.454.heavy.3.raw

SEQ ID NO: 451575 - DNA, 437 bp, Homo sapiens; identical to SEQ ID NO: 444603
  misc_feature: HEFZJCU01B0ORP.3.21.B10.1.454.heavy.3.raw

SEQ ID NO: 451576 - DNA, 385 bp, Homo sapiens; identical to SEQ ID NO: 444438
  misc_feature: HEFZJCU01D9ITP.18.60.F05.1.454.heavy.3.raw

SEQ ID NO: 451577 - DNA, 500 bp, Homo sapiens
  misc_feature: HEFZJCU01AEPJW.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatatggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccga

SEQ ID NO: 451578 - DNA, 503 bp, Homo sapiens
  misc_feature: HEFZJCU01DJI0X.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccatgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctggcgccctgct

SEQ ID NO: 451579 - DNA, 317 bp, Homo sapiens; identical to SEQ ID NO: 444484
  misc_feature: HEFZJCU01C0POF.13.66.F11.1.454.heavy.3.raw

SEQ ID NO: 451580 - DNA, 503 bp, Homo sapiens; identical to SEQ ID NO: 445995
  misc_feature: HEFZJCU01BMSDV.17.25.C03.1.454.heavy.3.raw

SEQ ID NO: 451581 - DNA, 533 bp, Homo sapiens
  misc_feature: HEFZJCU01BYCNJ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggttttccgttgttagctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaaccctggtcaccgttctccccaccctccaccg

SEQ ID NO: 451582 - DNA, 506 bp, Homo sapiens; identical to SEQ ID NO: 444696
  misc_feature: HEFZJCU01CIGDQ.16.34.D01.1.454.heavy.3.raw

SEQ ID NO: 451583 - DNA, 523 bp, Homo sapiens
  misc_feature: HEFZJCU01AQ8NQ.48.53.E09.1.454.heavy.3.raw
agtatacatacacgaccggtgctcgatttagagagagtgtgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccaggggaaccctggtcaccgtctcctcagcctccaccaagggcccatcggtcttcccctggcgccctgctccaggagcacc

SEQ ID NO: 451584 - DNA, 506 bp, Homo sapiens; identical to SEQ ID NO: 444732
  misc_feature: HEFZJCU01DMFBQ.14.78.H01.1.454.heavy.3.raw

SEQ ID NO: 451585 - DNA, 383 bp, Homo sapiens; identical to SEQ ID NO: 444477
  misc_feature: HEFZJCU01C9OIA.47.60.F05.1.454.heavy.3.raw

SEQ ID NO: 451586 - DNA, 513 bp, Homo sapiens
  misc_feature: HEFZJCU01AMCKT.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggttttccgttgttagccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccggggagccctgggt

SEQ ID NO: 451587 - DNA, 427 bp, Homo sapiens; identical to SEQ ID NO: 444708
  misc_feature: HEFZJCU01BEYPV.9.34.D01.1.454.heavy.3.raw

SEQ ID NO: 451588 - DNA, 501 bp, Homo sapiens
  misc_feature: HEFZJCU01CYDS8.52.19.B08.1.454.heavy.3.raw
cgcagtacgacacgaccggtgctcgatttagtgagtcagtaagggtgcaactggtggagtctggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggt

SEQ ID NO: 451589 - DNA, 542 bp, Homo sapiens
  misc_feature: HEFZJCU01D55AL.48.34.D01.1.454.heavy.3.raw
agtatacatacacgaccggtgctcgatttagatcgtctgtgttgggtttggggacttttccaatttttttgggggccagcgctgggtctcttgccaagagaaccccggagtagttgggggggctcaggaacctgccctaagacaacagcgtccacacagacgaggggctacgggtcctcacagacgaagggcacggggtccagatgatccctcctcctggccccgccacctcgtctctttctgcggccaggcgcactctgggcctctggggtcaagtggccggcaaccccgggccctcccggcctctgtctcagagagtcccagggacgtggcggggcgccggttcttccctggggtcctggcgttgttgtcaccttgtgtcacctgtttcgacccctgggcccagggagccctggtcaccgtctccttagcctccaccaagggcccatcggtcttccccctggccgccctgctccaggagcacctccgacgagcacagcggccctgggctgcctggtcaaggactacttcctatgtatact

SEQ ID NO: 451590 - DNA, 511 bp, Homo sapiens
  misc_feature: HEFZJCU01BUFKF.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 451591 - DNA, 523 bp, Homo sapiens
  misc_feature: HEFZJCU01C4WK8.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggaccaggggaccctggtcatcgtctccccagcctccaccaagggcccatcggtcttccccctggccg

SEQ ID NO: 451592 - DNA, 502 bp, Homo sapiens
  misc_feature: HEFZJCU01B7HOJ.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatcctttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttggcggtaaggcacagtatgcaccgaagatgaagggcagagtcacgattaccgacggacacccccacgaacacagtctacatgcaactgacgagcctgagagctgacgacacggccgtctattactgtgcgagaatgttttctgtcatcgtacatttgataggctctatggactggacttcgt

SEQ ID NO: 451593 - DNA, 500 bp, Homo sapiens; identical to SEQ ID NO: 445807
  misc_feature: HEFZJCU01EAHHD.40.81.H04.1.454.heavy.3.raw

SEQ ID NO: 451594 - DNA, 520 bp, Homo sapiens
  misc_feature: HEFZJCU01BN5QL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaaggggacccg

SEQ ID NO: 451595 - DNA, 512 bp, Homo sapiens
  misc_feature: HEFZJCU01B7LP8.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtgggggccccgggagccctggt

SEQ ID NO: 451596 - DNA, 495 bp, Homo sapiens
  misc_feature: HEFZJCU01EKUCW.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagt

SEQ ID NO: 451597 - DNA, 381 bp, Homo sapiens; identical to SEQ ID NO: 444427
  misc_feature: HEFZJCU01AGGYS.9.53.E09.1.454.heavy.3.raw

SEQ ID NO: 451598 - DNA, 506 bp, Homo sapiens; identical to SEQ ID NO: 444696
  misc_feature: HEFZJCU01EQYZC.16.34.D01.1.454.heavy.3.raw

SEQ ID NO: 451599 - DNA, 366 bp, Homo sapiens
  misc_feature: HEFZJCU01DR5A4.49.23.C01.1.454.heavy.3.raw
agtcgagagacacgaccggtgctcgatttagtacacgtgattgggattggggtctgaatcttatgccgactccgtgaagggccgattcaccatctccagagacaattccaagaacacactatatcttcaaatgaacagtctgagacgtgaagacacggctgtctattactgtgcgactgagatgtcttattacgatgccagtgctttagtaccgttcgacccctggggccagggagccctggtcaccgtctcctcagcttccaccaagggcccatcggtcttccccctggcgccctgctccaggagcacctctgggggcacagcggccctgggctgcctggtcaaggactacttcctctctcgact

SEQ ID NO: 451600 - DNA, 491 bp, Homo sapiens; identical to SEQ ID NO: 446104
  misc_feature: HEFZJCU01CH1GU.3.34.D01.1.454.heavy.3.raw

SEQ ID NO: 451601 - DNA, 494 bp, Homo sapiens
  misc_feature: HEFZJCU01DD83N.52.34.D01.1.454.heavy.3.raw
cgcagtacgacacgaccggtgctcgatttagatcgtctgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctggggacacagcggccctgggctgcctggtcaaggactacttcctatacgatcg

SEQ ID NO: 451602 - DNA, 379 bp, Homo sapiens
  misc_feature: HEFZJCU01AXD98.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtaaggacgtacttcctacgtgagct

SEQ ID NO: 451603 - DNA, 506 bp, Homo sapiens; identical to SEQ ID NO: 444696
  misc_feature: HEFZJCU01A1C0T.16.34.D01.1.454.heavy.3.raw

SEQ ID NO: 451604 - DNA, 437 bp, Homo sapiens; identical to SEQ ID NO: 444603
  misc_feature: HEFZJCU01AVAAP.3.21.B10.1.454.heavy.3.raw

SEQ ID NO: 451605 - DNA, 527 bp, Homo sapiens
  misc_feature: HEFZJCU01BL10A.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccgggaaccctggtcaccgtctcccacctccaccaac

SEQ ID NO: 451606 - DNA, 387 bp, Homo sapiens; identical to SEQ ID NO: 445170
  misc_feature: HEFZJCU01EPCWI.27.46.E02.1.454.heavy.3.raw

SEQ ID NO: 451607 - DNA, 396 bp, Homo sapiens; identical to SEQ ID NO: 444469
  misc_feature: HEFZJCU01B3A1F.47.46.E02.1.454.heavy.3.raw

SEQ ID NO: 451608 - DNA, 503 bp, Homo sapiens
  misc_feature: HEFZJCU01CKGXL.52.55.E11.1.454.heavy.3.raw
cgcagtacgacacgaccggtgctcgatttagcactcgcacgttgggtttgggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatgggtaaggatttttggagtaattattatcctggcggtgcgg

SEQ ID NO: 451609 - DNA, 494 bp, Homo sapiens
  misc_feature: HEFZJCU01DG7JK.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttatactgtgcgagagtctggggtgctacgagtactggtacttcgatctctggggccgtggcaccctgctgactgtctcctcagcctccaccaagggcccatcggtcttcccctggcgccctgctccaggagcacctccgagagcacagcggcctgggctgcctggtcaaggactacg

SEQ ID NO: 451610 - DNA, 518 bp, Homo sapiens; identical to SEQ ID NO: 444718
  misc_feature: HEFZJCU01BFW9Z.9.34.D01.1.454.heavy.3.raw

SEQ ID NO: 451611 - DNA, 436 bp, Homo sapiens
  misc_feature: HEFZJCU01DAHRS.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgactggtcaaggactacttccagtcgctaga

SEQ ID NO: 451612 - DNA, 508 bp, Homo sapiens
  misc_feature: HEFZJCU01EL8OX.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaaggcccatcggtcttcccctggcaccctcctccaagagcacctctgggggcacagcggccctgggctgcctggtcaaggactacttccgtact

SEQ ID NO: 451613 - DNA, 489 bp, Homo sapiens; identical to SEQ ID NO: 444791
  misc_feature: HEFZJCU01EWUJQ.47.85.H08.1.454.heavy.3.raw

SEQ ID NO: 451614 - DNA, 518 bp, Homo sapiens
  misc_feature: HEFZJCU01DZTGQ.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgttctgcaaatgaacagcctgagagccgaggacacggctgtgtatcactgtgtcagagatgccgagggccggttacccctctggttccttcgacagttatggtatggacgtcgtggggccgtagggactacggtcaccgtctcctcagcctccaccaacggcccatcggtccttcccctggccta

SEQ ID NO: 451615 - DNA, 482 bp, Homo sapiens
  misc_feature: HEFZJCU01CGWCB.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtccttccccctggcgccctgctccaggagcacctccgagagcacagcggccctgggctgcctggtcaaggactacttccacgcgtatgt

SEQ ID NO: 451616 - DNA, 482 bp, Homo sapiens
  misc_feature: HEFZJCU01EC2Y2.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggccaccctcctccaagagcacctctggggcacagcggccctgggctgcctggtcaaggactacttcctagagacacg

SEQ ID NO: 451617 - DNA, 410 bp, Homo sapiens
  misc_feature: HEFZJCU01ELKN4.9.11.A11.1.454.heavy.3.raw
tgatacgtctcacgaccggtgctcgatttagctacgactgcagggaagggcctggagtacattggggacatctatgccactgggagcaccgactacaacccgtccctcgagagtcgactctccatgtcccttgacacgtctaagaaccagtattccctgcaactgagctccgtgactgccgctgacacggccgtttattactgtgccataacagcctgtattactaccagttgctatcatctgagtccggacagctactttgtctcctggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 451618 - DNA, 509 bp, Homo sapiens
  misc_feature: HEFZJCU01CY74T.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaaggaggggggatacgagtggcagctccaagtacttacg

SEQ ID NO: 451619 - DNA, 480 bp, Homo sapiens; identical to SEQ ID NO: 446171
  misc_feature: HEFZJCU01CCKFM.22.36.D03.1.454.heavy.3.raw

SEQ ID NO: 451620 - DNA, 482 bp, Homo sapiens
  misc_feature: HEFZJCU01CGCBW.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaccgaagacacgggcgtgtattttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 451621 - DNA, 314 bp, Homo sapiens; identical to SEQ ID NO: 450221
  misc_feature: HEFZJCU01CPNAH.13.17.B06.1.454.heavy.3.raw

SEQ ID NO: 451622 - DNA, 512 bp, Homo sapiens; identical to SEQ ID NO: 445688
  misc_feature: HEFZJCU01DIBTU.3.34.D01.1.454.heavy.3.raw

SEQ ID NO: 451623 - DNA, 502 bp, Homo sapiens
  misc_feature: HEFZJCU01A7AO5.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcgggctgaccacgtggggaccg

SEQ ID NO: 451624 - DNA, 534 bp, Homo sapiens
  misc_feature: HEFZJCU01DAJTV.22.38.D05.1.454.heavy.3.raw
acatacgcgtcacgaccggtgctcgatttagtatctgatagttgggtttggggagtgactcctgtgccccaccatggacacactttgctccacgctcctgctgctgacccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaaccctggtcaccgtctcctcagcctccaccaagggcccatcggtcttcccctc

SEQ ID NO: 451625 - DNA, 516 bp, Homo sapiens
  misc_feature: HEFZJCU01DOMLK.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccactaggtttgactacgtgggccagggaacgctggtcaccgtctcctc

SEQ ID NO: 451626 - DNA, 500 bp, Homo sapiens; identical to SEQ ID NO: 444529
  misc_feature: HEFZJCU01CZJOM.12.38.D05.1.454.heavy.3.raw

SEQ ID NO: 451627 - DNA, 512 bp, Homo sapiens
  misc_feature: HEFZJCU01CNQ50.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccgagcgggagttccaagtactcctttg

SEQ ID NO: 451628 - DNA, 487 bp, Homo sapiens
  misc_feature: HEFZJCU01CWBP4.51.12.B01.1.454.heavy.3.raw
cgatcgtatacacgaccggtgctcgatttagtagtgtagattccgcggggtctgggagacgagcccagcactggaagtcgccggtgtttccattcggtgatcatcactgaacacagaggactcaccatggagtttgggctgagcgtggtttcgcgtaggctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcaactacgcagagtccgtgaagggccgattgaccatctccagagacaactcgaagaatacggttcttctacaaatgaaacagcctgagagtgaggagacgcgtatgtttacttagtgcgagaggaacgtacg

SEQ ID NO: 451629 - DNA, 488 bp, Homo sapiens; identical to SEQ ID NO: 444651
  misc_feature: HEFZJCU01CWN9E.16.67.G01.1.454.heavy.3.raw

SEQ ID NO: 451630 - DNA, 518 bp, Homo sapiens
  misc_feature: HEFZJCU01DZLHQ.49.5.A05.1.454.heavy.3.raw
agtcgagagacacgaccggtgctcgatttagatagatagacaggggctgggagacgagcccagcactggaagtcgccggtgtttccattcggtgatcatcactgaacacagaggactcaccatggagtttgggctgagcgtggttttccgtcgttaggctcttttaagtaaggtgtccagtgtcaggtgtagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactactggggccagggtaa

SEQ ID NO: 451631 - DNA, 522 bp, Homo sapiens
  misc_feature: HEFZJCU01AU7JI.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccaggggacaatggtcaccgtctctttcagt

SEQ ID NO: 451632 - DNA, 512 bp, Homo sapiens
  misc_feature: HEFZJCU01CHQ07.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactactggggccagggaaccctggtcaccggt

SEQ ID NO: 451633 - DNA, 512 bp, Homo sapiens
  misc_feature: HEFZJCU01DB4W8.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtcgacccccgtcc

SEQ ID NO: 451634 - DNA, 523 bp, Homo sapiens
  misc_feature: HEFZJCU01A8GNL.2.37.D04.1.454.heavy.3.raw
acgctcgacacacgaccggtgctcgatttagtagcatactgttgggtttggggaagtagtccttgaccaggcagcccaggactggtgaagccttcggagaccctgtccctcacctgcactgtctctggtggctccattagtagttactactggacctggatccggcagaccccagggaagggactggagtggattgggtatgtctataacagtgggagcaccaactacaatccctccctgaagagtcgggtcaccatatcagttgacacgtccaagaaccagttctccctgaaactgaggtctgtgaccgatgcggacacggccgtatattattgtgcgagagtccctcttcagggcggctattactccggtctggacgtctggggccaagggaccacggtcaccgtctcctcagcctccaccaagggcccatcggtcttcccctggcaccctcctccaagagcacctctgggggcacagcggccctgggctgcctggtcaaggactacttcctgtcgagcgt

SEQ ID NO: 451635 - DNA, 339 bp, Homo sapiens; identical to SEQ ID NO: 444436
  misc_feature: HEFZJCU01EA62A.47.38.D05.1.454.heavy.3.raw

SEQ ID NO: 451636 - DNA, 508 bp, Homo sapiens
  misc_feature: HEFZJCU01AZ0CP.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgacaaatgaatagcctgagagccggaggacacggctggtgttattactgttgtcagagagtggggaggggggtggtgtactccgta

SEQ ID NO: 451637 - DNA, 378 bp, Homo sapiens
  misc_feature: HEFZJCU01CRK90.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcagcgtctcctcagcctccaccaagggcccatcggtcttccccctggcgccctgctccaggagcacctccgagagcacagcggccctgggctgcctggtcaaggactacttcctacgtgagct

SEQ ID NO: 451638 - DNA, 547 bp, Homo sapiens
  misc_feature: HEFZJCU01CW1O4.21.46.E02.1.454.heavy.3.raw
tcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactgggagtgggttattattcctggggccagggaaccctggtaaccgtctcctcagcctccaccaagggcccatcggtcttcccctggcgccctgctccaggagcacctccgagagcacagcggccctgggctgcctggtcaaggactacttccga

SEQ ID NO: 451639 - DNA, 506 bp, Homo sapiens
  misc_feature: HEFZJCU01DFDZ8.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacaggacttaccatgaccacgaactcctccaataaacacagcctacatggagttgaggagcctgacatctgacgacacggccgtctattactgtgcgtagagtcccacgatccggtgagcctacggcagcggcctttgacttctc

SEQ ID NO: 451640 - DNA, 511 bp, Homo sapiens
  misc_feature: HEFZJCU01BZ68R.49.25.C03.1.454.heavy.3.raw
agtcgagagacacgaccggtgctcgatttagtagtgtagatttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattaacggtgaccacacctattttgacca

SEQ ID NO: 451641 - DNA, 482 bp, Homo sapiens
  misc_feature: HEFZJCU01C57LE.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggcctgggctgcctggtcaaggactacttccgtatctctcg

SEQ ID NO: 451642 - DNA, 508 bp, Homo sapiens
  misc_feature: HEFZJCU01CDQ4L.49.86.H09.1.454.heavy.3.raw
agtcgagagacacgaccggtgctcgatttagtgctatagacttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttga

SEQ ID NO: 451643 - DNA, 502 bp, Homo sapiens
  misc_feature: HEFZJCU01BSQRB.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatggtcttcccctggcaccctcctccaagagcacctctgggggcacagcggccctgggctgcctggtcaaggactacttccgctacgtaga

SEQ ID NO: 451644 - DNA, 440 bp, Homo sapiens
  misc_feature: HEFZJCU01A1069.48.23.C01.1.454.heavy.3.raw
agtatacatacacgaccggtgctcgatttagtacacgtgattagggattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtgagtcgtggttcgacccctggggccagggtaccctggtcattgtctcctcagcttccaccaagggcccatcggtcttccccctggcgccctgctccaggagcacctctgggggcacagcggccctgggctgcctggtcaaggactacttcctatgtatact

SEQ ID NO: 451645 - DNA, 397 bp, Homo sapiens
  misc_feature: HEFZJCU01CSQ29.48.24.C02.1.454.heavy.3.raw
agtatacatacacgaccggtgctcgatttagtacagatcgttagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 451646 - DNA, 444 bp, Homo sapiens
  misc_feature: HEFZJCU01B4XPA.3.86.H09.1.454.heavy.3.raw
agacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctgggggcacagcggccctggctgcctggtcaaggactacttccgagtgcgtct

SEQ ID NO: 451647 - DNA, 508 bp, Homo sapiens
  misc_feature: HEFZJCU01CFD3Y.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggcacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 451648 - DNA, 533 bp, Homo sapiens
  misc_feature: HEFZJCU01A7UUX.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcgtcttcccctc

SEQ ID NO: 451649 - DNA, 522 bp, Homo sapiens; identical to SEQ ID NO: 446788
  misc_feature: HEFZJCU01BEH8T.12.40.D07.1.454.heavy.3.raw

SEQ ID NO: 451650 - DNA, 398 bp, Homo sapiens
  misc_feature: HEFZJCU01DJXUG.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcgcctgggctgcctggtcaaggactacttcctacgtgagct

SEQ ID NO: 451651 - DNA, 517 bp, Homo sapiens; identical to SEQ ID NO: 444897
  misc_feature: HEFZJCU01EZ0FN.9.34.D01.1.454.heavy.3.raw

SEQ ID NO: 451652 - DNA, 501 bp, Homo sapiens
  misc_feature: HEFZJCU01CL2KH.17.10.A10.1.454.heavy.3.raw
cgtagactagcacgaccggtgctcgatttagcgtcgatctcaggggacccaaaaaccacacccctccttggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtactattgataggctctatggactggtacttcgtc

SEQ ID NO: 451653 - DNA, 529 bp, Homo sapiens; identical to SEQ ID NO: 447055
  misc_feature: HEFZJCU01DRYGY.17.34.D01.1.454.heavy.3.raw

SEQ ID NO: 451654 - DNA, 521 bp, Homo sapiens; identical to SEQ ID NO: 445351
  misc_feature: HEFZJCU01EGO7I.19.86.H09.1.454.heavy.3.raw

SEQ ID NO: 451655 - DNA, 392 bp, Homo sapiens; identical to SEQ ID NO: 444682
  misc_feature: HEFZJCU01EJZAL.16.70.G04.1.454.heavy.3.raw

SEQ ID NO: 451656 - DNA, 510 bp, Homo sapiens
  misc_feature: HEFZJCU01B2QO3.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgaattcg

SEQ ID NO: 451657 - DNA, 518 bp, Homo sapiens; identical to SEQ ID NO: 451556
  misc_feature: HEFZJCU01C08HJ.13.76.G10.1.454.heavy.3.raw

SEQ ID NO: 451658 - DNA, 503 bp, Homo sapiens
  misc_feature: HEFZJCU01AHH1H.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaacgggcccatcggtctccccctggccgccctgctcc

SEQ ID NO: 451659 - DNA, 505 bp, Homo sapiens; identical to SEQ ID NO: 445664
  misc_feature: HEFZJCU01DCQUM.12.33.C11.1.454.heavy.3.raw

SEQ ID NO: 451660 - DNA, 534 bp, Homo sapiens
  misc_feature: HEFZJCU01BCXKK.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacggtgaatcttcaaatgaacagcctgagaaccgaggacacggccgtatattattgtataggttatggtggtaattcgggccctggggccagggaaccgtggtcaccgtctcctcagcctccaccaac

SEQ ID NO: 451661 - DNA, 527 bp, Homo sapiens
  misc_feature: HEFZJCU01EW4G9.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttcccctggcaccctcctccaagagcacctctgggggcacagcggcctggctgcct

SEQ ID NO: 451662 - DNA, 510 bp, Homo sapiens
  misc_feature: HEFZJCU01AVG1C.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccatctattactgtgcgagagccgcgaatatgtggtgcaaagatggtcgttgtttgtttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccta

SEQ ID NO: 451663 - DNA, 502 bp, Homo sapiens
  misc_feature: HEFZJCU01DVR7K.52.38.D05.1.454.heavy.3.raw
cgcagtacgacacgaccggtgctcgatttagtatctgatagttgggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaaggcccatcggtcttcccctggcaccctcctccaag

SEQ ID NO: 451664 - DNA, 479 bp, Homo sapiens; identical to SEQ ID NO: 447128
  misc_feature: HEFZJCU01CT09T.4.37.D04.1.454.heavy.3.raw

SEQ ID NO: 451665 - DNA, 493 bp, Homo sapiens
  misc_feature: HEFZJCU01B354D.49.82.H05.1.454.heavy.3.raw
agtcgagagacacgaccggtgctcgatttagtcgagctctctcgcgggggctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaaacagcgg

SEQ ID NO: 451666 - DNA, 470 bp, Homo sapiens; identical to SEQ ID NO: 444866
  misc_feature: HEFZJCU01C2EAQ.4.36.D03.1.454.heavy.3.raw

SEQ ID NO: 451667 - DNA, 478 bp, Homo sapiens
  misc_feature: HEFZJCU01E1351.12.5.A05.1.454.heavy.3.raw
atacgacgtacacgaccggtgctcgatttagatagatagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcatgggaggcgtggtccaacctggaaagtccctgagcctctcctgtgcagcctctggattcacattcagtacccgtgctatgcagtgggtgcgccaggctccaggcaaggggctggactgggtggccgttatagcacctgatggcaatgtgaagtattatgcagactccgtgaggggccgattcacgatcttaagagacaattcgaagaacactctgtatctacagatggacagcctgagagttgaagacacggctctttattactgtgcgagagagaattacgatttgactctcggtcg

SEQ ID NO: 451668 - DNA, 396 bp, Homo sapiens; identical to SEQ ID NO: 444469
  misc_feature: HEFZJCU01BPFYZ.47.46.E02.1.454.heavy.3.raw

SEQ ID NO: 451669 - DNA, 506 bp, Homo sapiens
  misc_feature: HEFZJCU01C8V58.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaacgggcccatcggtcttcccctggcgccctgctccaggagcacctccgagagcacagcggcctgggctgcctggtcaaggactacttcctatgtatact

SEQ ID NO: 451670 - DNA, 516 bp, Homo sapiens
  misc_feature: HEFZJCU01A3IVO.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttacgtcacccatactactttgaacttacgtggggacccg

SEQ ID NO: 451671 - DNA, 396 bp, Homo sapiens; identical to SEQ ID NO: 444469
  misc_feature: HEFZJCU01BJDU8.47.46.E02.1.454.heavy.3.raw

SEQ ID NO: 451672 - DNA, 477 bp, Homo sapiens
  misc_feature: HEFZJCU01EOI5Q.16.71.G05.1.454.heavy.3.raw
tgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgactggtcaaggactacttccgagtagtaca

SEQ ID NO: 451673 - DNA, 509 bp, Homo sapiens
  misc_feature: HEFZJCU01CPTU2.53.35.D02.1.454.heavy.3.raw
cgcgtatacacacgaccggtgctcgatttagcacacgatagttgggtttgggctgagctgggttttcctcgttgctcttttaagaggtgtccagtgtcacgtgcagctggtgcagtctggggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaaccctggtcaccgtctcctcagcttccaccaaggcccatcggtcttcccctcggcgtcccg

SEQ ID NO: 451674 - DNA, 509 bp, Homo sapiens; identical to SEQ ID NO: 444586
  misc_feature: HEFZJCU01A315U.12.78.H01.1.454.heavy.3.raw

SEQ ID NO: 451675 - DNA, 502 bp, Homo sapiens
  misc_feature: HEFZJCU01BP286.51.78.H01.1.454.heavy.3.raw
cgatcgtatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggta

SEQ ID NO: 451676 - DNA, 437 bp, Homo sapiens; identical to SEQ ID NO: 444603
  misc_feature: HEFZJCU01AM9FM.3.21.B10.1.454.heavy.3.raw

SEQ ID NO: 451677 - DNA, 417 bp, Homo sapiens
  misc_feature: HEFZJCU01D6V38.40.20.B09.1.454.heavy.3.raw
tctagcgactcacgaccggtgctcgatttagtgtagtgtgaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaagggaccacggttaccgtctcctcagcctccaccaagggcccatcggtcttccccctggcgccctgctccaggagcacctccgagagcacagcggccctgggctgcctggtcaaggactacttccagtcgctaga

SEQ ID NO: 451678 - DNA, 533 bp, Homo sapiens
  misc_feature: HEFZJCU01D1XKI.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacggggcgtttattactgtgcgagaggggacggactacgggtgactacgtgggggttcgaccccgtggggccaggggaaccctggtcaccggtctcctcagcctccaccg

SEQ ID NO: 451679 - DNA, 503 bp, Homo sapiens
  misc_feature: HEFZJCU01CEHPJ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccaatatattactgtgcgaaagcaccggcagttagtcacccatactactttgactac

SEQ ID NO: 451680 - DNA, 384 bp, Homo sapiens; identical to SEQ ID NO: 444454
  misc_feature: HEFZJCU01BS1QP.11.61.F06.1.454.heavy.3.raw

SEQ ID NO: 451681 - DNA, 535 bp, Homo sapiens
  misc_feature: HEFZJCU01DTIMX.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacgggccgtgtattactgtgcgagatgtaggaaaaagtatggctgtgtttatggggccagggagccctggtcaccg

SEQ ID NO: 451682 - DNA, 505 bp, Homo sapiens
  misc_feature: HEFZJCU01AX2ZM.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcct

SEQ ID NO: 451683 - DNA, 489 bp, Homo sapiens; identical to SEQ ID NO: 444591
  misc_feature: HEFZJCU01ED6IM.18.70.G04.1.454.heavy.3.raw

SEQ ID NO: 451684 - DNA, 386 bp, Homo sapiens
  misc_feature: HEFZJCU01A5BFS.16.59.F04.1.454.heavy.3.raw
tgtactactccacgaccggtgctcgatttagtacacacacttagggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttccccctggcaccctcctccaagagcacctctggggcacagcggccctgggctgcctggtcaaggactacttccgagtagtaca

SEQ ID NO: 451685 - DNA, 522 bp, Homo sapiens
  misc_feature: HEFZJCU01EN6ET.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttacgcctggttatttacc

SEQ ID NO: 451686 - DNA, 514 bp, Homo sapiens
  misc_feature: HEFZJCU01DROMP.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccagggaactctggtcaccgtctccgcagcctccaccaagggccc

SEQ ID NO: 451687 - DNA, 511 bp, Homo sapiens
  misc_feature: HEFZJCU01ANTD0.9.12.B01.1.454.heavy.3.raw
tgatacgtctcacgaccggtgctcgatttagtagtgtagattccgcggggagctctgggagaggagcccagcactgggattccgaggtgtttccattcagtgatctgcactgaacacagaggactcgccatggagtttgggctgagcgtgggttttccgttgttagctattttaaaaggttggtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaatgaacagcctgagagtcgaggacacggctgtatattactgtgcgagagatgtgtacgcttttgatatctggggccaa

SEQ ID NO: 451688 - DNA, 437 bp, Homo sapiens; identical to SEQ ID NO: 444603
  misc_feature: HEFZJCU01BGTHQ.3.21.B10.1.454.heavy.3.raw

SEQ ID NO: 451689 - DNA, 508 bp, Homo sapiens; identical to SEQ ID NO: 446002
  misc_feature: HEFZJCU01EN3XA.9.78.H01.1.454.heavy.3.raw

SEQ ID NO: 451690 - DNA, 519 bp, Homo sapiens; identical to SEQ ID NO: 444867
  misc_feature: HEFZJCU01D1COL.9.34.D01.1.454.heavy.3.raw

SEQ ID NO: 451691 - DNA, 535 bp, Homo sapiens
  misc_feature: HEFZJCU01CAZ5X.48.43.D10.1.454.heavy.3.raw
agtatacatacacgaccggtgctcgatttagactagcagtaaggggacatgggaagtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccagggaaaactggtcaccgtctcctcagcttccaccaacggcccatcggtcttcccctc

SEQ ID NO: 451692 - DNA, 499 bp, Homo sapiens
  misc_feature: HEFZJCU01EME0T.13.87.H10.1.454.heavy.3.raw
  modified_base (485)..(485): a, c, t, g, unknown or other
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagntccaacccttacgt

SEQ ID NO: 451693 - DNA, 312 bp, Homo sapiens
  misc_feature: HEFZJCU01BDPRN.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggccctgggctgcctggtcaaggactacttcctagagacacg

SEQ ID NO: 451694 - DNA, 555 bp, Homo sapiens
  misc_feature: HEFZJCU01BMYU0.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagtaatctggagctgaacagcctgtcatctgaggacgacgggcgttctacttcttgtgcgaggagtaattactataacactggggggtctccttttaccttaccttccctttcgtacttcttcggggtccgacgtcggtaaccccgggtacccg

SEQ ID NO: 451695 - DNA, 390 bp, Homo sapiens; identical to SEQ ID NO: 444541
  misc_feature: HEFZJCU01CO81O.16.24.C02.1.454.heavy.3.raw

SEQ ID NO: 451696 - DNA, 396 bp, Homo sapiens; identical to SEQ ID NO: 444469
  misc_feature: HEFZJCU01D4CPS.47.46.E02.1.454.heavy.3.raw

SEQ ID NO: 451697 - DNA, 396 bp, Homo sapiens; identical to SEQ ID NO: 444469
  misc_feature: HEFZJCU01CDK05.47.46.E02.1.454.heavy.3.raw

SEQ ID NO: 451698 - DNA, 336 bp, Homo sapiens
  misc_feature: HEFZJCU01EZEHI.51.45.E01.1.454.heavy.3.raw
cgatcgtatacacgaccggtgctcgatttagtgagtcagtaagggaaagggcccattcgccatctccagagacaattccaaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 451699 - DNA, 374 bp, Homo sapiens; identical to SEQ ID NO: 444640
  misc_feature: HEFZJCU01CJ3ZV.7.37.D04.1.454.heavy.3.raw

SEQ ID NO: 451700 - DNA, 532 bp, Homo sapiens
  misc_feature: HEFZJCU01ESPNC.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacactttttttgactattgggccagggaatcctggtcaccgtcgcctcagcctccaccaagggcccatcggtcttcccccg

SEQ ID NO: 451701 - DNA, 503 bp, Homo sapiens; identical to SEQ ID NO: 445995
  misc_feature: HEFZJCU01ELO9I.17.25.C03.1.454.heavy.3.raw

SEQ ID NO: 451702 - DNA, 384 bp, Homo sapiens; identical to SEQ ID NO: 444454
  misc_feature: HEFZJCU01CUHD7.11.61.F06.1.454.heavy.3.raw

SEQ ID NO: 451703 - DNA, 501 bp, Homo sapiens
  misc_feature: HEFZJCU01BFWR7.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctcggcgccctgctccaggagcacctccgagagcacagcggccctgggctgcctggtcaaggactacttcctacgtcgtat

SEQ ID NO: 451704 - DNA, 379 bp, Homo sapiens
  misc_feature: HEFZJCU01DR74L.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctggggacacagcggccctgggctgcctggtcaaggactacttcctacgtgagct

SEQ ID NO: 451705 - DNA, 503 bp, Homo sapiens
  misc_feature: HEFZJCU01A6TC6.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcttcggtccgcgggacttcg

SEQ ID NO: 451706 - DNA, 448 bp, Homo sapiens
  misc_feature: HEFZJCU01C2JUI.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttcccctggcgccctgctccaggagcacctccgagagcacagcggcctgggctgcctggtcaaggactacttccagacgtatca

SEQ ID NO: 451707 - DNA, 528 bp, Homo sapiens
  misc_feature: HEFZJCU01ALYQA.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattacaaaaagtacactgtatctggaaatgaacagcctgagaatcgacgacacagccgtttattactgcagaagagggcactatcggtccctggggccagggaaccctggtccaccgtctcctca

SEQ ID NO: 451708 - DNA, 512 bp, Homo sapiens
  misc_feature: HEFZJCU01EY0VL.16.15.B04.1.454.heavy.3.raw
tgtactactccacgaccggtgctcgatttagacagtatatatccgcggggagctctgagagaggagcccagccctgggattttcaggtgttttcatttggtgatcagggctgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcatctttagcagctatgtcatgacctgggtccgccaggctccagggaaggggctggagtgggtctcagttattggtggtagtggttataccacatactacgcagactccgtgaagggccggttcaccatctccagagacaattccaagaacacactatatctgcaaatgaacagcctgagagccgaggacacggccgtatattactgtgcgaaaggccaggggtatagcagtggctggtacctaac

SEQ ID NO: 451709 - DNA, 324 bp, Homo sapiens
  misc_feature: HEFZJCU01DY60D.4.19.B08.1.454.heavy.3.raw
agcactgtagcacgaccggtgctcgatttagtgagtcagtaagggtcgattcaccatctccagagacaatcgcaagaacacactgtatctggaaatgaccagcctgagaggtgacgacacgggtgtttattactgtgcgcgggatagaggctcatcgtggatacaactatggtttgattactggggccacggaaccctggtcaccgtctcttcagcttccaccaagggcccatcggtcttccccctggcgccctgctccaggagcacctctgggggcacagcggccctgggctgcctggtcaaggactacttccctacagtgct

SEQ ID NO: 451710 - DNA, 500 bp, Homo sapiens; identical to SEQ ID NO: 444529
  misc_feature: HEFZJCU01B07FD.12.38.D05.1.454.heavy.3.raw

SEQ ID NO: 451711 - DNA, 396 bp, Homo sapiens; identical to SEQ ID NO: 444469
  misc_feature: HEFZJCU01C1RKA.47.46.E02.1.454.heavy.3.raw

SEQ ID NO: 451712 - DNA, 384 bp, Homo sapiens; identical to SEQ ID NO: 444454
  misc_feature: HEFZJCU01B0ZIU.11.61.F06.1.454.heavy.3.raw

SEQ ID NO: 451713 - DNA, 510 bp, Homo sapiens
  misc_feature: HEFZJCU01DWRIH.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggactctgtcaccgtctccgcagcctccaccaagggccc

SEQ ID NO: 451714 - DNA, 518 bp, Homo sapiens
  misc_feature: HEFZJCU01DDAMO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaggcccatcggtcttcccctgcg

SEQ ID NO: 451715 - DNA, 511 bp, Homo sapiens
  misc_feature: HEFZJCU01C701C.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttccgaccccgg

SEQ ID NO: 451716 - DNA, 396 bp, Homo sapiens; identical to SEQ ID NO: 444469
  misc_feature: HEFZJCU01B99RF.47.46.E02.1.454.heavy.3.raw

SEQ ID NO: 451717 - DNA, 519 bp, Homo sapiens
  misc_feature: HEFZJCU01AS4F7.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgaggcggagttccaagtacttccg

SEQ ID NO: 451718 - DNA, 507 bp, Homo sapiens
  misc_feature: HEFZJCU01C10NF.48.32.C10.1.454.heavy.3.raw
agtatacatacacgaccggtgctcgatttagtatagacatcaacacacaaagggggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattttatagcgggagcacctactataatccgtccctcaagagtcgagtcaccatatccgtagacacatccaagaaccagttctccctgaggctgagccctgtgaccgccgtagacacggctgtctattactgtgcgacccatcgatatcatgactggttgttagggcacgtctggggccaagggaccacggtcaccgtctcctcacg

SEQ ID NO: 451719 - DNA, 512 bp, Homo sapiens
  misc_feature: HEFZJCU01EKDWK.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccagcgggagtccaagtactcctttg

SEQ ID NO: 451720 - DNA, 510 bp, Homo sapiens
  misc_feature: HEFZJCU01C7KL5.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagatggggcccacgaacgttactacgctatggacgtctgggg

SEQ ID NO: 451721 - DNA, 375 bp, Homo sapiens
  misc_feature: HEFZJCU01DFSFQ.49.37.D04.1.454.heavy.3.raw
agtcgagagacacgaccggtgctcgatttagtagcatactgttgggtttgggggggagaggagcccagcactgggattccgaggtgtttccattcagtgatctgcactgaacacagaggactcgccatggagtttgggctgagctgggttttccttgttgctattttaaaaggtgtccagtgtgatgtgcaggtggtggagcccgggtatagcagtgtctggtacatattactggggccagggaaccctggtcaccgtctcctcagcctccaccaagggcccatcggtcttccccctggcgccctgctccaggagcacctccgagagcacagcggccctgggctgcctggtcaaggactacttcctctctcgact

SEQ ID NO: 451722 - DNA, 475 bp, Homo sapiens; identical to SEQ ID NO: 445138
  misc_feature: HEFZJCU01AMPFV.3.39.D06.1.454.heavy.3.raw

SEQ ID NO: 451723 - DNA, 517 bp, Homo sapiens; identical to SEQ ID NO: 448924
  misc_feature: HEFZJCU01COIX9.7.78.H01.1.454.heavy.3.raw

SEQ ID NO: 451724 - DNA, 385 bp, Homo sapiens; identical to SEQ ID NO: 444438
  misc_feature: HEFZJCU01B7B01.18.60.F05.1.454.heavy.3.raw

SEQ ID NO: 451725 - DNA, 480 bp, Homo sapiens
  misc_feature: HEFZJCU01ASE0U.48.12.B01.1.454.heavy.3.raw
agtatacatacacgaccggtgctcgatttagtagtgtagattccgcgggcacgaccggtgctcgatttagtacacgtgattagggattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtgagtcgtggttcgacccctggggccagggtaccctggtcattgtctcctcagcttccaccaagggcccatcggtcttccccctggcgccctgctccaggagcacctctgggggcacagcggccctggggctgcctggtcaaggactacttcctatgtatact

SEQ ID NO: 451726 - DNA, 511 bp, Homo sapiens; identical to SEQ ID NO: 446224
  misc_feature: HEFZJCU01B2WM0.7.28.C06.1.454.heavy.3.raw

SEQ ID NO: 451727 - DNA, 531 bp, Homo sapiens
  misc_feature: HEFZJCU01C6E2P.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagttgggtttttttttcgtactacgggtagtc

SEQ ID NO: 451728 - DNA, 491 bp, Homo sapiens
  misc_feature: HEFZJCU01EP1NM.48.34.D01.1.454.heavy.3.raw
agtatacatacacgaccggtgctcgatttagatcgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttcccctggcgccctgctccaggagcacctccgagagcacagcggccctcgggctgcctggtcaaggactacttcctatgtatact

SEQ ID NO: 451729 - DNA, 508 bp, Homo sapiens; identical to SEQ ID NO: 445594
  misc_feature: HEFZJCU01EKP5S.17.25.C03.1.454.heavy.3.raw

SEQ ID NO: 451730 - DNA, 519 bp, Homo sapiens; identical to SEQ ID NO: 446650
  misc_feature: HEFZJCU01BFK5A.13.76.G10.1.454.heavy.3.raw

SEQ ID NO: 451731 - DNA, 493 bp, Homo sapiens
  misc_feature: HEFZJCU01BLKJG.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgtgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggcctgcctggtcaaggactacttccgagtgcgtct

SEQ ID NO: 451732 - DNA, 517 bp, Homo sapiens
  misc_feature: HEFZJCU01C3DD1.22.28.C06.1.454.heavy.3.raw
acatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgcaaccctccctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctgggccagggaaccctggtcaccgtctcctcagcctccaccaaggcccatcggtcttccccctggccaccctcctccaagagcacctctgggggcac

SEQ ID NO: 451733 - DNA, 492 bp, Homo sapiens
  misc_feature: HEFZJCU01DNJBO.48.30.C08.1.454.heavy.3.raw
agtatacatacacgaccggtgctcgatttagtctgacgtcaaagggaaagggggcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaagatttcctgcaaggcatctggatacatcttcaccacctacaatatacactgggtgcgacacggcccctcgacaagggcctgagtggagtggggatgatcaaccctaggtatggcagcacaagccacgcagagaagttccagggcagagttatcatgaccagcgacacgtccacgagcacagtctacatgagtctgagcagcctgagatctgaagacacggccgtctattactgtgcgaggagggggggtgggtccccaaggtaccg

SEQ ID NO: 451734 - DNA, 513 bp, Homo sapiens; identical to SEQ ID NO: 447518
  misc_feature: HEFZJCU01BLC8S.19.67.G01.1.454.heavy.3.raw

SEQ ID NO: 451735 - DNA, 483 bp, Homo sapiens; identical to SEQ ID NO: 444639
  misc_feature: HEFZJCU01EO19R.11.23.C01.1.454.heavy.3.raw

SEQ ID NO: 451736 - DNA, 507 bp, Homo sapiens
  misc_feature: HEFZJCU01DWU6H.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 451737 - DNA, 511 bp, Homo sapiens
  misc_feature: HEFZJCU01DI5T5.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcaccctggtcactgtctcctcggcttccaccaagggcccatcggtcttcccctgcgcctgctccaggagcacctctggggcacgagcggcccg

SEQ ID NO: 451738 - DNA, 323 bp, Homo sapiens
  misc_feature: HEFZJCU01D2B23.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctctggggcacagcggccctgggctgcctggtcaaggactacttcccatactcgta

SEQ ID NO: 451739 - DNA, 491 bp, Homo sapiens; identical to SEQ ID NO: 445333
  misc_feature: HEFZJCU01ERI47.19.53.E09.1.454.heavy.3.raw

SEQ ID NO: 451740 - DNA, 501 bp, Homo sapiens
  misc_feature: HEFZJCU01B9K59.51.23.C01.1.454.heavy.3.raw
cgatcgtatacacgaccggtgctcgatttagtacacgtgattagggattggggatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggccctttattactgtgcgagatttaccgtgggggtcacggcggatatatcgccatactta

SEQ ID NO: 451741 - DNA, 515 bp, Homo sapiens
  misc_feature: HEFZJCU01C136T.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctggggaccg

SEQ ID NO: 451742 - DNA, 395 bp, Homo sapiens; identical to SEQ ID NO: 444517
  misc_feature: HEFZJCU01C4GUT.16.68.G02.1.454.heavy.3.raw

SEQ ID NO: 451743 - DNA, 488 bp, Homo sapiens
  misc_feature: HEFZJCU01AGTGV.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaggactacttcccacgagagta

SEQ ID NO: 451744 - DNA, 514 bp, Homo sapiens; identical to SEQ ID NO: 449806
  misc_feature: HEFZJCU01DTIL1.4.12.B01.1.454.heavy.3.raw

SEQ ID NO: 451745 - DNA, 468 bp, Homo sapiens
  misc_feature: HEFZJCU01AWOA5.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaggactactccctacagtgct

SEQ ID NO: 451746 - DNA, 521 bp, Homo sapiens; identical to SEQ ID NO: 445317
  misc_feature: HEFZJCU01ELMXD.12.40.D07.1.454.heavy.3.raw

SEQ ID NO: 451747 - DNA, 486 bp, Homo sapiens
  misc_feature: HEFZJCU01CJ4MN.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgcctgctccaggagcacctccgagagcacagcggccctggctgcctggtcaggactacttcccatactcgta

SEQ ID NO: 451748 - DNA, 483 bp, Homo sapiens
  misc_feature: HEFZJCU01EQFT7.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattatgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactaccttcccactactatg

SEQ ID NO: 451749 - DNA, 511 bp, Homo sapiens
  misc_feature: HEFZJCU01EEHKQ.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccaggggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtcttatttctgtgcgagactgcccggtcctgcacctcgtgtcggccctaatttcggtttaccggcacacaaatcagggcaagtcctacgacggtctgg

SEQ ID NO: 451750 - DNA, 519 bp, Homo sapiens
  misc_feature: HEFZJCU01DBSTF.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggtgcacagcggccctgggctgcctggtcaaggactacttccagacgtatca

SEQ ID NO: 451751 - DNA, 518 bp, Homo sapiens
  misc_feature: HEFZJCU01BQ45C.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 451752 - DNA, 519 bp, Homo sapiens
  misc_feature: HEFZJCU01CIDYU.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagccgaccggcagttagtccacccattacctactttagactacgtggggaccc

SEQ ID NO: 451753 - DNA, 368 bp, Homo sapiens; identical to SEQ ID NO: 444437
  misc_feature: HEFZJCU01DF2YT.12.12.B01.1.454.heavy.3.raw

SEQ ID NO: 451754 - DNA, 518 bp, Homo sapiens
  misc_feature: HEFZJCU01DX6C0.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctgcaccctcctccaagagcacctctgggggcacagcggccctgggctgcctggtcaaggactacttccagacgtatca

SEQ ID NO: 451755 - DNA, 491 bp, Homo sapiens; identical to SEQ ID NO: 446104
  misc_feature: HEFZJCU01D167S.3.34.D01.1.454.heavy.3.raw

SEQ ID NO: 451756 - DNA, 396 bp, Homo sapiens; identical to SEQ ID NO: 444469
  misc_feature: HEFZJCU01BDTPK.47.46.E02.1.454.heavy.3.raw

SEQ ID NO: 451757 - DNA, 486 bp, Homo sapiens; identical to SEQ ID NO: 448316
  misc_feature: HEFZJCU01EFAZD.3.48.E04.1.454.heavy.3.raw

SEQ ID NO: 451758 - DNA, 477 bp, Homo sapiens
  misc_feature: HEFZJCU01EIPLU.16.71.G05.1.454.heavy.3.raw
tgtactactccacgaccggtgctcgatttagtgtcgtcgcaagagagaggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 451759 - DNA, 500 bp, Homo sapiens; identical to SEQ ID NO: 446033
  misc_feature: HEFZJCU01EBU0W.11.27.C05.1.454.heavy.3.raw

SEQ ID NO: 451760 - DNA, 483 bp, Homo sapiens
  misc_feature: HEFZJCU01E1PRE.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccatacg

SEQ ID NO: 451761 - DNA, 507 bp, Homo sapiens
  misc_feature: HEFZJCU01EWLQG.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactatgcagactccgtgaagggccggttcaccatctccagagacaattccaagaacacactgtatctgcaaatgaacagcctgagagccgacgacacggccatatattactgtgcgaaagcaccggcagttagtcacccatactactttgactactc

SEQ ID NO: 451762 - DNA, 481 bp, Homo sapiens
  misc_feature: HEFZJCU01DDVDH.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctgcgccctgctccaggagcacctccgagagcacagcggccctgggctgcctggtcaaggactactcccactactatg

SEQ ID NO: 451763 - DNA, 519 bp, Homo sapiens; identical to SEQ ID NO: 446650
  misc_feature: HEFZJCU01CO4TH.13.76.G10.1.454.heavy.3.raw

SEQ ID NO: 451764 - DNA, 491 bp, Homo sapiens; identical to SEQ ID NO: 444592
  misc_feature: HEFZJCU01EUANU.11.26.C04.1.454.heavy.3.raw

SEQ ID NO: 451765 - DNA, 516 bp, Homo sapiens
  misc_feature: HEFZJCU01E05X9.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagccaaccggcagttagtccacccatactactttgactacgtggggaccg

SEQ ID NO: 451766 - DNA, 505 bp, Homo sapiens
  misc_feature: HEFZJCU01EI47M.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctcaccaagggcccatcggtcttcccctggcgccctgctccaggagcacctccgagagcacagcggccctgggctgcctggtcaaggactacttcctatgtatact

SEQ ID NO: 451767 - DNA, 517 bp, Homo sapiens; identical to SEQ ID NO: 446608
  misc_feature: HEFZJCU01BFGRK.9.34.D01.1.454.heavy.3.raw

SEQ ID NO: 451768 - DNA, 505 bp, Homo sapiens
  misc_feature: HEFZJCU01C3GDM.47.57.F02.1.454.heavy.3.raw
agctcacgtacacgaccggtgctcgatttagctcgatatagttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgattgccttcggtccgcgggacttctggggccaggg

SEQ ID NO: 451769 - DNA, 514 bp, Homo sapiens; identical to SEQ ID NO: 449003
  misc_feature: HEFZJCU01DU8UO.4.57.F02.1.454.heavy.3.raw

SEQ ID NO: 451770 - DNA, 510 bp, Homo sapiens
  misc_feature: HEFZJCU01D88WD.4.67.G01.1.454.heavy.3.raw
  modified_base (440)..(440): a, c, t, g, unknown or other
  modified_base (500)..(500): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgttttctaggtggctattttaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccggtgaagggccgcttcaccatctccagagacaattccaagaacacggtgtatctgcaaatgaacngcctgagagccgaggacacggccacataattactgtgcgaaagatctcgggctggttccncggtccgggt

SEQ ID NO: 451771 - DNA, 518 bp, Homo sapiens
  misc_feature: HEFZJCU01EMZTN.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgaccctggggccagggaacccttgtcaccgtctcctcagcctccaccaagggcccacg

SEQ ID NO: 451772 - DNA, 513 bp, Homo sapiens
  misc_feature: HEFZJCU01EYPS3.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccgggagcccctggtcc

SEQ ID NO: 451773 - DNA, 378 bp, Homo sapiens
  misc_feature: HEFZJCU01ECOAS.47.77.G11.1.454.heavy.3.raw
agctcacgtacacgaccggtgctcgatttagctagtcactcaagggaaaggggctagagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 451774 - DNA, 498 bp, Homo sapiens; identical to SEQ ID NO: 449655
  misc_feature: HEFZJCU01DSBQG.48.34.D01.1.454.heavy.3.raw

SEQ ID NO: 451775 - DNA, 464 bp, Homo sapiens; identical to SEQ ID NO: 445533
  misc_feature: HEFZJCU01EBBR9.19.10.A10.1.454.heavy.3.raw

SEQ ID NO: 451776 - DNA, 516 bp, Homo sapiens
  misc_feature: HEFZJCU01A86ES.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtata

SEQ ID NO: 451777 - DNA, 506 bp, Homo sapiens
  misc_feature: HEFZJCU01DSAG5.12.78.H01.1.454.heavy.3.raw
atacgacgtacacgaccggtgctcgatttagtgtgagtagtttgggtttgggggaggcttggtacagcctggggggtccccgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcacctcctccaagagcacctctgggggcacagcggcctgggctgcctggtcaaggactactcctacgtcgtat

SEQ ID NO: 451778 - DNA, 400 bp, Homo sapiens; identical to SEQ ID NO: 444452
  misc_feature: HEFZJCU01CSFN2.47.24.C02.1.454.heavy.3.raw

SEQ ID NO: 451779 - DNA, 461 bp, Homo sapiens
  misc_feature: HEFZJCU01EU696.48.52.E08.1.454.heavy.3.raw
agtatacatacacgaccggtgctcgatttagtcgagctctcccgcgagagagaggggcaagggcgccagatggtccttcctcgtgagtcccaggaccaccctcggcctctggggtccagagtccaacaacccccgggccctccccggcctcaacctgagagagattcccagggacgttttccctggggtcctgacattgttgtcacaatgtgacaactgagtcgaccctggggccagagaaccctggtcaccgtctcctcagggtgaggatggacattccgccactgtgatcacttccactactgcggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatgtatact

SEQ ID NO: 451780 - DNA, 519 bp, Homo sapiens; identical to SEQ ID NO: 448820
  misc_feature: HEFZJCU01ELZZT.2.11.A11.1.454.heavy.3.raw

SEQ ID NO: 451781 - DNA, 490 bp, Homo sapiens
  misc_feature: HEFZJCU01COZE8.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactactccgtatctctcg

SEQ ID NO: 451782 - DNA, 403 bp, Homo sapiens; identical to SEQ ID NO: 444540
  misc_feature: HEFZJCU01CNJXA.16.72.G06.1.454.heavy.3.raw

SEQ ID NO: 451783 - DNA, 514 bp, Homo sapiens
  misc_feature: HEFZJCU01CM73W.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacaacggcccatatattactgtgcgaaagcaccggcagttagtcaccatactactttgactactggggccaac

SEQ ID NO: 451784 - DNA, 400 bp, Homo sapiens; identical to SEQ ID NO: 444452
  misc_feature: HEFZJCU01D7T18.47.24.C02.1.454.heavy.3.raw

SEQ ID NO: 451785 - DNA, 512 bp, Homo sapiens
  misc_feature: HEFZJCU01CZHR1.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaaccctggtcaccgtctcttcagcctccaccaagggcccatcggtcttcccctggcaccctcctccaagagcacctctgggggc

SEQ ID NO: 451786 - DNA, 505 bp, Homo sapiens
  misc_feature: HEFZJCU01D9UDU.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactggggtccgccaggcttccgggagagggcttgagtgggtggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 451787 - DNA, 506 bp, Homo sapiens
  misc_feature: HEFZJCU01BQQG3.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtactta

SEQ ID NO: 451788 - DNA, 504 bp, Homo sapiens
  misc_feature: HEFZJCU01EXCWD.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtcctggggccggaacccgggtc

SEQ ID NO: 451789 - DNA, 437 bp, Homo sapiens
  misc_feature: HEFZJCU01CCS52.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctctgggggcacagcggccctgggctgcctggtcaaggactacttccgagtgcgtct

SEQ ID NO: 451790 - DNA, 519 bp, Homo sapiens
  misc_feature: HEFZJCU01EXP22.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgcccctacgcgcacttcttgacttctgggcca

SEQ ID NO: 451791 - DNA, 495 bp, Homo sapiens; identical to SEQ ID NO: 445359
  misc_feature: HEFZJCU01CIFX7.4.21.B10.1.454.heavy.3.raw

SEQ ID NO: 451792 - DNA, 482 bp, Homo sapiens
  misc_feature: HEFZJCU01AFEFJ.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccatacg

SEQ ID NO: 451793 - DNA, 495 bp, Homo sapiens
  misc_feature: HEFZJCU01B8ZOT.48.35.D02.1.454.heavy.3.raw
agtatacatacacgaccggtgctcgatttagcacacgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccaggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccct

SEQ ID NO: 451794 - DNA, 527 bp, Homo sapiens
  misc_feature: HEFZJCU01B7654.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacgagcggccctgggctgcctggtcaaggactacttccg

SEQ ID NO: 451795 - DNA, 505 bp, Homo sapiens; identical to SEQ ID NO: 444927
  misc_feature: HEFZJCU01AKJB3.17.31.C09.1.454.heavy.3.raw

SEQ ID NO: 451796 - DNA, 483 bp, Homo sapiens; identical to SEQ ID NO: 444532
  misc_feature: HEFZJCU01DWM3X.47.59.F04.1.454.heavy.3.raw

SEQ ID NO: 451797 - DNA, 521 bp, Homo sapiens
  misc_feature: HEFZJCU01D1N4H.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctgcg

SEQ ID NO: 451798 - DNA, 522 bp, Homo sapiens
  misc_feature: HEFZJCU01CT5MR.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgacgtctcctcagcctccaccaagggccatcggtcttcccctggcgccctgctccaggagcacctccgagagcacagcggccctgggc

SEQ ID NO: 451799 - DNA, 469 bp, Homo sapiens
  misc_feature: HEFZJCU01B3WRX.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaaggggcaatggtcaccgtctcttcagcctccaccaagggcccatcggtcttcccctggcgccctgctccaggagcacctccgagagcacagcggccctgggctgcctggtcaaggactactccctacagtgct

SEQ ID NO: 451800 - DNA, 503 bp, Homo sapiens; identical to SEQ ID NO: 451156
  misc_feature: HEFZJCU01A4RFI.26.80.H03.1.454.heavy.3.raw

SEQ ID NO: 451801 - DNA, 385 bp, Homo sapiens
  misc_feature: HEFZJCU01EHJ6R.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccagggcaccctggtcaccgtctcctcagcttccaccaagggcccatcggtcttccccctggcgccctcctccaagagcacctctgggggcacagcggccctgggctgcctggtcaaggactacttcccatactcgta

SEQ ID NO: 451802 - DNA, 523 bp, Homo sapiens; identical to SEQ ID NO: 448340
  misc_feature: HEFZJCU01BCX7L.12.33.C11.1.454.heavy.3.raw

SEQ ID NO: 451803 - DNA, 515 bp, Homo sapiens
  misc_feature: HEFZJCU01EUECS.51.26.C04.1.454.heavy.3.raw
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtat

SEQ ID NO: 451804 - DNA, 502 bp, Homo sapiens
  misc_feature: HEFZJCU01E2A0O.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgtcttttgtatatctggggccaagggac

SEQ ID NO: 451805 - DNA, 379 bp, Homo sapiens
  misc_feature: HEFZJCU01AKLUN.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcctcagcctccaccaagggcccatcggtcttccccctggcaccctcctccaagagcacctctgggggcacagcggccctgggctgcctggtcaaggactacttcctacgtgagct

SEQ ID NO: 451806 - DNA, 514 bp, Homo sapiens
  misc_feature: HEFZJCU01EEKM4.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccaac

SEQ ID NO: 451807 - DNA, 316 bp, Homo sapiens; identical to SEQ ID NO: 444479
  misc_feature: HEFZJCU01ESMQ9.47.84.H07.1.454.heavy.3.raw

SEQ ID NO: 451808 - DNA, 531 bp, Homo sapiens; identical to SEQ ID NO: 446857
  misc_feature: HEFZJCU01CZ4DZ.7.78.H01.1.454.heavy.3.raw

SEQ ID NO: 451809 - DNA, 510 bp, Homo sapiens
  misc_feature: HEFZJCU01DMSZ6.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactacttcccata

SEQ ID NO: 451810 - DNA, 506 bp, Homo sapiens
  misc_feature: HEFZJCU01BKONY.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactactccc

SEQ ID NO: 451811 - DNA, 487 bp, Homo sapiens; identical to SEQ ID NO: 446769
  misc_feature: HEFZJCU01ENS3S.22.86.H09.1.454.heavy.3.raw

SEQ ID NO: 451812 - DNA, 482 bp, Homo sapiens; identical to SEQ ID NO: 444503
  misc_feature: HEFZJCU01DX5Y1.7.10.A10.1.454.heavy.3.raw

SEQ ID NO: 451813 - DNA, 527 bp, Homo sapiens
  misc_feature: HEFZJCU01C76XF.21.78.H01.1.454.heavy.3.raw
tcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccacctccaccaac

SEQ ID NO: 451814 - DNA, 531 bp, Homo sapiens; identical to SEQ ID NO: 446857
  misc_feature: HEFZJCU01C944B.7.78.H01.1.454.heavy.3.raw

SEQ ID NO: 451815 - DNA, 530 bp, Homo sapiens
  misc_feature: HEFZJCU01EYBVL.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttgggccagggaaccctggtcaccgtctcctcagcctccaccaagggcccatcggtcttcccctggcaccctcctccaagagcacctctgggggcacagcggccctgggctgcctc

SEQ ID NO: 451816 - DNA, 437 bp, Homo sapiens; identical to SEQ ID NO: 444603
  misc_feature: HEFZJCU01ALDDO.3.21.B10.1.454.heavy.3.raw

SEQ ID NO: 451817 - DNA, 540 bp, Homo sapiens
  misc_feature: HEFZJCU01DC20R.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacgacgggcgtttattactgtgcgagagggacggactacggtgacttacgtgggggtttcgaccccgttgggggccctaggggaaccctggtccaaccgtctcctcacgccctccaccg

SEQ ID NO: 451818 - DNA, 476 bp, Homo sapiens
  misc_feature: HEFZJCU01A3C0Z.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagctgtggcacaaagtatgcacagaagtttcagggcagggtcaccatgaccagggacacgtccatcagcacgtccatcagcacagcctacatggacctgagcggcctgacatctgacgacacggccgtatatttctgtgcga

SEQ ID NO: 451819 - DNA, 483 bp, Homo sapiens; identical to SEQ ID NO: 444924
  misc_feature: HEFZJCU01COWDD.10.35.D02.1.454.heavy.3.raw

SEQ ID NO: 451820 - DNA, 537 bp, Homo sapiens
  misc_feature: HEFZJCU01DA9FC.13.24.C02.1.454.heavy.3.raw
tcacgtactacacgaccggtgctcgatttagtacagatcgttagggaaaggggctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcgggtccctgagactctcctgtgtagtttctgggctcacgtttgttgatcgtgccatgcactgggtccgccaaagtccagggaaggcctggagtgggtctcaggtatttatgggaacagtgaaagaatagggtatgcggactctgtgaagggccgattcaccatctccagagacaacgccaagaactccctctttttgcaaatgaacagtctgaaaactgaggactcggccttatattactgtctcaaagaaagtaataaatgggggtctcgactactggggccagggagcctggtcaccgtctcct

SEQ ID NO: 451821 - DNA, 480 bp, Homo sapiens
  misc_feature: HEFZJCU01CQZOU.12.5.A05.1.454.heavy.3.raw
atacgacgtacacgaccggtgctcgatttagatagatagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcatgggaggcgtggtccaacctggaaagtccctgagccgtctccgtgtagcagcctctggattcacattcagtacccgtgctatgcagtgggtgcgccaggctccaggcaaggggctggactgggtggccgttatagcacctgatggcaatgtgaagtattatgcagactccgtgaggggccgattcacgatcttaagagacaattcgaagaacactctgtatctacagatggacagcctgagagttgaagacacggctctttattactgtgcgagagagaattacgatttgactctcggtg

SEQ ID NO: 451822 - DNA, 517 bp, Homo sapiens; identical to SEQ ID NO: 445616
  misc_feature: HEFZJCU01BCYE8.9.34.D01.1.454.heavy.3.raw

SEQ ID NO: 451823 - DNA, 379 bp, Homo sapiens; identical to SEQ ID NO: 444450
  misc_feature: HEFZJCU01BRPRL.47.77.G11.1.454.heavy.3.raw

SEQ ID NO: 451824 - DNA, 400 bp, Homo sapiens; identical to SEQ ID NO: 444452
  misc_feature: HEFZJCU01C3S84.47.24.C02.1.454.heavy.3.raw

SEQ ID NO: 451825 - DNA, 524 bp, Homo sapiens
  misc_feature: HEFZJCU01BR1NU.9.78.H01.1.454.heavy.3.raw
tgatacgtctcacgaccggtgctcgatttagtgtgagtagtttgggtttgggtgccgaagttgttggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 451826 - DNA, 385 bp, Homo sapiens; identical to SEQ ID NO: 444438
  misc_feature: HEFZJCU01EASCX.18.60.F05.1.454.heavy.3.raw

SEQ ID NO: 451827 - DNA, 533 bp, Homo sapiens
  misc_feature: HEFZJCU01C5JIW.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttattttgtacgtagagcgtcgtctgtcagtggaattgactactgggccagggaaccctggtcaccgtctcctcagcctccaccaacggg

SEQ ID NO: 451828 - DNA, 514 bp, Homo sapiens
  misc_feature: HEFZJCU01ERKJQ.52.83.H06.1.454.heavy.3.raw
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtgtttattactgtacgaacttaattacggaggacaacggtaaccccgtccgcacggcac

SEQ ID NO: 451829 - DNA, 429 bp, Homo sapiens; identical to SEQ ID NO: 447944
  misc_feature: HEFZJCU01D6K1J.4.37.D04.1.454.heavy.3.raw

SEQ ID NO: 451830 - DNA, 520 bp, Homo sapiens
  misc_feature: HEFZJCU01CORJK.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcaggggattcgactactggggccagggaaccctggtcaccgtctcctcagcctccaccaaggg

SEQ ID NO: 451831 - DNA, 402 bp, Homo sapiens; identical to SEQ ID NO: 447546
  misc_feature: HEFZJCU01BP40D.16.72.G06.1.454.heavy.3.raw

SEQ ID NO: 451832 - DNA, 506 bp, Homo sapiens
  misc_feature: HEFZJCU01DDZMY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgacgcctacggcagcggcctttgacttcgtc

SEQ ID NO: 451833 - DNA, 518 bp, Homo sapiens
  misc_feature: HEFZJCU01D37X9.5.78.H01.1.454.heavy.3.raw
atcagacacgcacgaccggtgctcgatttagtgtgagtagtttgggtttggggggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgactccgtgaagggccgattcaccatctccagagacaattccaagaacactctgtatctgcaaatggacagcctgagacctgaggacacggctgtgtattactgtgcgaaagaaaccggcgggcagtggctgggcccatttgaccactgggccagggaaccctggtcaccgtctcctcagcctccaccaagggcccatccggtccttccccctggcaccctcctccaagagcacctctgggggcacagcggcctggctgcctggtcaaggactacttcccg

SEQ ID NO: 451834 - DNA, 434 bp, Homo sapiens
  misc_feature: HEFZJCU01A9UYO.14.74.G08.1.454.heavy.3.raw
cgtctagtaccacgaccggtgctcgatttagtagctctatcagggatccggcagctcccagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 451835 - DNA, 504 bp, Homo sapiens; identical to SEQ ID NO: 445222
  misc_feature: HEFZJCU01AIWOJ.9.33.C11.1.454.heavy.3.raw

SEQ ID NO: 451836 - DNA, 498 bp, Homo sapiens; identical to SEQ ID NO: 445952
  misc_feature: HEFZJCU01DFGKY.11.71.G05.1.454.heavy.3.raw

SEQ ID NO: 451837 - DNA, 510 bp, Homo sapiens
  misc_feature: HEFZJCU01CJC1S.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggctactt

SEQ ID NO: 451838 - DNA, 515 bp, Homo sapiens
  misc_feature: HEFZJCU01AOR3F.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactaacgggaaagtcttttgatctcgtggggccaagggacacgtggtcaccgtctcttcagcctccaccaacgggcccatcggtccttcccctggccgccctgcctccaggacg

SEQ ID NO: 451839 - DNA, 495 bp, Homo sapiens
  misc_feature: HEFZJCU01CPAGX.51.53.E09.1.454.heavy.3.raw
cgatcgtatacacgaccggtgctcgatttagagagagtgtgttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 451840 - DNA, 518 bp, Homo sapiens; identical to SEQ ID NO: 445220
  misc_feature: HEFZJCU01BWL3E.9.70.G04.1.454.heavy.3.raw

SEQ ID NO: 451841 - DNA, 516 bp, Homo sapiens
  misc_feature: HEFZJCU01CL7ZC.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttcgggtttcgttctagtgcctggtttgtagaacgtggggccgagggaacgtctggtcgaccgtccgtcctccacgcctccacccg

SEQ ID NO: 451842 - DNA, 509 bp, Homo sapiens
  misc_feature: HEFZJCU01DLEDK.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtccttccccctggccaccctcctccaagagcacctctgggggcacagcggccctgggctgcctggtcaaggactacttcctagtacgtga

SEQ ID NO: 451843 - DNA, 513 bp, Homo sapiens; identical to SEQ ID NO: 446699
  misc_feature: HEFZJCU01D8OSW.12.25.C03.1.454.heavy.3.raw

SEQ ID NO: 451844 - DNA, 494 bp, Homo sapiens
  misc_feature: HEFZJCU01A2TTA.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactgggcgacggaaccgtacggtcgaccgtccgtcctctagcc

SEQ ID NO: 451845 - DNA, 432 bp, Homo sapiens; identical to SEQ ID NO: 446029
  misc_feature: HEFZJCU01DE47U.11.39.D06.1.454.heavy.3.raw

SEQ ID NO: 451846 - DNA, 527 bp, Homo sapiens
  misc_feature: HEFZJCU01AQ08T.49.28.C06.1.454.heavy.3.raw
  modified_base (503)..(503): a, c, t, g, unknown or other
agtcgagagacacgaccggtgctcgatttagagctcacgtattgggtttgggctgagcgtggtttcgtgtagctatttaaaggtgtccagtgtgacgtgcaggtggtggagtctggggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaacccctggtcaccgtctcctcagcctccaccaagggcccatcggtcttccccctggccgccctcgctccnggagcacctcccgagagcacagcc

SEQ ID NO: 451847 - DNA, 517 bp, Homo sapiens
  misc_feature: HEFZJCU01AFH3F.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggtggttcgacccctggggccagggaccctggtcaccgtctcctcagcct

SEQ ID NO: 451848 - DNA, 509 bp, Homo sapiens; identical to SEQ ID NO: 446792
  misc_feature: HEFZJCU01BF22Y.18.39.D06.1.454.heavy.3.raw

SEQ ID NO: 451849 - DNA, 518 bp, Homo sapiens
  misc_feature: HEFZJCU01EN72V.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacgacgccgtcttattactgttggttagggtagttttacgttagttttggta

SEQ ID NO: 451850 - DNA, 509 bp, Homo sapiens
  misc_feature: HEFZJCU01AMX0U.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagcgtggtttcgtgtaggctatttaaagtgccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaac

SEQ ID NO: 451851 - DNA, 526 bp, Homo sapiens
  misc_feature: HEFZJCU01CZRA8.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagcctggggggtccctgagactctcctgtgcagcctctgggttcaccgtcagtcacacctacatgagttgggtccgccaggctccagggaagggctggagtgggtctccgtttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccagaacgttactacgctatggacgtctggggccaagggaccac

SEQ ID NO: 451852 - DNA, 508 bp, Homo sapiens
  misc_feature: HEFZJCU01A8JVA.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaagggcccatcggtcttccccctggccaccctcct

SEQ ID NO: 451853 - DNA, 497 bp, Homo sapiens
  misc_feature: HEFZJCU01CB7TI.40.34.D01.1.454.heavy.3.raw
tctagcgactcacgaccggtgctcgatttagatcgtctgtgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttcccctggcgccctgctccaggagcacctccgagagcacagcggccctgggctggcctggtcaaggactacttccagtcgctaga

SEQ ID NO: 451854 - DNA, 522 bp, Homo sapiens; identical to SEQ ID NO: 446788
  misc_feature: HEFZJCU01BQPEE.12.40.D07.1.454.heavy.3.raw

SEQ ID NO: 451855 - DNA, 505 bp, Homo sapiens
  misc_feature: HEFZJCU01BAQOT.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctggggcccggaaccgggtc

SEQ ID NO: 451856 - DNA, 506 bp, Homo sapiens; identical to SEQ ID NO: 444696
  misc_feature: HEFZJCU01E1XO1.16.34.D01.1.454.heavy.3.raw

SEQ ID NO: 451857 - DNA, 400 bp, Homo sapiens; identical to SEQ ID NO: 444452
  misc_feature: HEFZJCU01A33D4.47.24.C02.1.454.heavy.3.raw

SEQ ID NO: 451858 - DNA, 517 bp, Homo sapiens
  misc_feature: HEFZJCU01EHIHT.9.33.C11.1.454.heavy.3.raw
tgatacgtctcacgaccggtgctcgatttagagtgagctcgttgggtttgggagcccagcactagaagtcggcggtgtttccattcggtgatcagcactgaacacagaggactcaccatggagtttgggctgagcgtggtttcgtcgtagctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacgagtggcagctccaagtactactttgacttctggggccg

SEQ ID NO: 451859 - DNA, 514 bp, Homo sapiens
  misc_feature: HEFZJCU01DZAH7.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctacttgactactggggccagggactctggtcaccgtctccgcagcctccaccaaggcccatcc

SEQ ID NO: 451860 - DNA, 481 bp, Homo sapiens
  misc_feature: HEFZJCU01CQIC6.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccataga

SEQ ID NO: 451861 - DNA, 514 bp, Homo sapiens
  misc_feature: HEFZJCU01EDJ6C.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtccttccccctggcca

SEQ ID NO: 451862 - DNA, 504 bp, Homo sapiens
  misc_feature: HEFZJCU01CJFYP.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctggggcac

SEQ ID NO: 451863 - DNA, 398 bp, Homo sapiens; identical to SEQ ID NO: 444798
  misc_feature: HEFZJCU01EDJPU.4.60.F05.1.454.heavy.3.raw

SEQ ID NO: 451864 - DNA, 507 bp, Homo sapiens
  misc_feature: HEFZJCU01EPAUI.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgaaagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctggctgcctggtcaaggactacttccgagtgcgtct

SEQ ID NO: 451865 - DNA, 492 bp, Homo sapiens
  misc_feature: HEFZJCU01ASXTS.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatcttctcg

SEQ ID NO: 451866 - DNA, 513 bp, Homo sapiens
  misc_feature: HEFZJCU01CA9AK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgacgcctacggcaggccggcccttttggacctttcgtc

SEQ ID NO: 451867 - DNA, 323 bp, Homo sapiens
  misc_feature: HEFZJCU01EHNAO.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggactacttcccatactcgta

SEQ ID NO: 451868 - DNA, 526 bp, Homo sapiens
  misc_feature: HEFZJCU01CHOD3.12.40.D07.1.454.heavy.3.raw
atacgacgtacacgaccggtgctcgatttagtgatagagcgtaacaacagaggactcaccatggagtttgggctgagcgtggttttctcgttagctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaaagacacccttttatctgcaaatagacagcctgagaccagacgacacggctgtctattattgcgcgagagagacacacgaacctactggccaatactatggggcttgttctggggccaggggaccctggtcatcgtctcccagcctccaccaagggcccatccggtcttcccctggccgcctcg

SEQ ID NO: 451869 - DNA, 513 bp, Homo sapiens
  misc_feature: HEFZJCU01BZYF8.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaaccagttctgcacaaaagttccagggcagactcaccctgactacagacgcatcaacgggctcagccttcatgaccctgaggaacctgagacctgacgacgcggccatctattactgtgcgagagatgggtggcagctcgtctcaggaattgacttctggggcccggaacctgatcaccg

SEQ ID NO: 451870 - DNA, 524 bp, Homo sapiens
  misc_feature: HEFZJCU01EPKMQ.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 451871 - DNA, 524 bp, Homo sapiens
  misc_feature: HEFZJCU01ELVI4.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtattactgtgtggggcatttacttgaccctggggccggggaacctggtcaccgtctccccaccctccaccg

SEQ ID NO: 451872 - DNA, 518 bp, Homo sapiens; identical to SEQ ID NO: 444718
  misc_feature: HEFZJCU01EUWK7.9.34.D01.1.454.heavy.3.raw

SEQ ID NO: 451873 - DNA, 483 bp, Homo sapiens; identical to SEQ ID NO: 444639
  misc_feature: HEFZJCU01CADKY.11.23.C01.1.454.heavy.3.raw

SEQ ID NO: 451874 - DNA, 500 bp, Homo sapiens; identical to SEQ ID NO: 444529
  misc_feature: HEFZJCU01BWPT8.12.38.D05.1.454.heavy.3.raw

SEQ ID NO: 451875 - DNA, 489 bp, Homo sapiens; identical to SEQ ID NO: 444791
  misc_feature: HEFZJCU01APHFS.47.85.H08.1.454.heavy.3.raw

SEQ ID NO: 451876 - DNA, 519 bp, Homo sapiens; identical to SEQ ID NO: 445330
  misc_feature: HEFZJCU01DTPUI.7.78.H01.1.454.heavy.3.raw

SEQ ID NO: 451877 - DNA, 505 bp, Homo sapiens
  misc_feature: HEFZJCU01BTNAL.49.20.B09.1.454.heavy.3.raw
agtcgagagacacgaccggtgctcgatttagtgtagtgtgaaggggacccaacaaccacatccctcctcagaagccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttatactgtgcgagagggaagtgggatattgtggcagctccaggtgcccaggcccgggcccctactttgactac

SEQ ID NO: 451878 - DNA, 524 bp, Homo sapiens
  misc_feature: HEFZJCU01CURS8.13.4.A04.1.454.heavy.3.raw
tcacgtactacacgaccggtgctcgatttagagtagtgatcagggggagagaggagcccagccctgggattttcaggtgttttcatttggtgatcaggactgaacagagagaactcaccatggaatttgggctgagctggctttttcttgtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctaataccttttgacttactggggccaggggaaccctggtccg

SEQ ID NO: 451879 - DNA, 527 bp, Homo sapiens
  misc_feature: HEFZJCU01ES5VF.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccacc

SEQ ID NO: 451880 - DNA, 535 bp, Homo sapiens
  misc_feature: HEFZJCU01DXSQ1.49.31.C09.1.454.heavy.3.raw
agtcgagagacacgaccggtgctcgatttagacgtctcatcaaggaaggaagggggagagaggagcccagccctgggattttcaggtgttttcatttggtgatcaggactgaacagagagaactcaccatggagtttgggctgagctggctttttcttgtggcttttttaaaaggtgtccagtgtgaggtggagctgttggagtctgggggaggcttggtacaatttggggggtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgctttgatgtctggggccaaggggacaagtggtcc

SEQ ID NO: 451881 - DNA, 379 bp, Homo sapiens; identical to SEQ ID NO: 444450
  misc_feature: HEFZJCU01EU3XE.47.77.G11.1.454.heavy.3.raw

SEQ ID NO: 451882 - DNA, 518 bp, Homo sapiens
  misc_feature: HEFZJCU01CISNX.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 451883 - DNA, 489 bp, Homo sapiens; identical to SEQ ID NO: 447707
  misc_feature: HEFZJCU01AH36U.10.55.E11.1.454.heavy.3.raw

SEQ ID NO: 451884 - DNA, 359 bp, Homo sapiens
  misc_feature: HEFZJCU01B7BSX.14.39.D06.1.454.heavy.3.raw
cgtctagtaccacgaccggtgctcgatttagtgacatctcgcagtgggagcagcaactacaacccctccctcaagagtcgagtcgacatattagtagacacgtccgagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacg

SEQ ID NO: 451885 - DNA, 519 bp, Homo sapiens
  misc_feature: HEFZJCU01CEN7J.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtctcccctggcg

SEQ ID NO: 451886 - DNA, 336 bp, Homo sapiens; identical to SEQ ID NO: 444510
  misc_feature: HEFZJCU01DU5AS.3.31.C09.1.454.heavy.3.raw

SEQ ID NO: 451887 - DNA, 524 bp, Homo sapiens; identical to SEQ ID NO: 445889
  misc_feature: HEFZJCU01BV0S1.18.33.C11.1.454.heavy.3.raw

SEQ ID NO: 451888 - DNA, 467 bp, Homo sapiens; identical to SEQ ID NO: 445159
  misc_feature: HEFZJCU01DQVY9.48.7.A07.1.454.heavy.3.raw

SEQ ID NO: 451889 - DNA, 555 bp, Homo sapiens
  misc_feature: HEFZJCU01ALPE6.49.10.A10.1.454.heavy.3.raw
agtcgagagacacgaccggtgctcgatttagcgtcgatctcagggggggagacgagcccagcactggaagtcgccggtgtttccattcggtgatcatcactgaacacagaggactcaccatggagtttgggctgagcgtgggttttcctcgactgctcttttaagagacgtccactgttttgtgggcctggtggagtctggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgttttgcggacacggctgtttattattgtgcgacagggggcccccctttccgtacggagcgatcatacctaactttcgtaccacgttcggggccgacgggaacccgtcggtccgaccgt

SEQ ID NO: 451890 - DNA, 323 bp, Homo sapiens; identical to SEQ ID NO: 444416
  misc_feature: HEFZJCU01ACRRC.47.38.D05.1.454.heavy.3.raw

SEQ ID NO: 451891 - DNA, 477 bp, Homo sapiens; identical to SEQ ID NO: 444659
  misc_feature: HEFZJCU01CKEJC.16.10.A10.1.454.heavy.3.raw

SEQ ID NO: 451892 - DNA, 516 bp, Homo sapiens
  misc_feature: HEFZJCU01DE4S1.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttg

SEQ ID NO: 451893 - DNA, 522 bp, Homo sapiens
  misc_feature: HEFZJCU01E03WI.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctcggcg

SEQ ID NO: 451894 - DNA, 525 bp, Homo sapiens
  misc_feature: HEFZJCU01BJS4S.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctcggcgaccctcctccaagagcacctctgggggcacagcc

SEQ ID NO: 451895 - DNA, 480 bp, Homo sapiens
  misc_feature: HEFZJCU01DY7SJ.11.63.F08.1.454.heavy.3.raw
cgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgtgcgagagataaaggggattgtgatacg

SEQ ID NO: 451896 - DNA, 532 bp, Homo sapiens
  misc_feature: HEFZJCU01BA9HS.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttccgaccccgtggggcccaggggaacccctggtcaccgtctcctcagcctccaccg

SEQ ID NO: 451897 - DNA, 519 bp, Homo sapiens
  misc_feature: HEFZJCU01B7H6I.52.74.G08.1.454.heavy.3.raw
cgcagtacgacacgaccggtgctcgatttagtagctctatcaggggatgctttctgagagtcatggacctcccgcgcaagaacatgaagcacctgtggtttttcctcctgctggtgacagctcccagagggtcctgtcccaggtgcagctccaggagtcgggccccggactaatgaagccctcggagaccctctcactcacctgcaatgtctctggatattcaattgggagtggttattattgggcctggatccggcagcccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgacacggccctttattactgtgcgcgagtgaacacagcaataacttattatgttgaatattggggccagggaaccccggtcaccatctcctcagcctccaccaagggcccatcc

SEQ ID NO: 451898 - DNA, 498 bp, Homo sapiens
  misc_feature: HEFZJCU01BB1C8.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaaggcccatcgtcttcccctggcgccctgctccaggagcacctccgagagcacagcggccctgggctgcctggtcaaggactacttcctacgtcgtat

SEQ ID NO: 451899 - DNA, 503 bp, Homo sapiens; identical to SEQ ID NO: 450415
  misc_feature: HEFZJCU01CUXHS.15.55.E11.1.454.heavy.3.raw

SEQ ID NO: 451900 - DNA, 501 bp, Homo sapiens
  misc_feature: HEFZJCU01CQDUA.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagcgtgagtttcctttagggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagatccaacccttacgatttttggagtt

SEQ ID NO: 451901 - DNA, 507 bp, Homo sapiens
  misc_feature: HEFZJCU01C5DN8.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtcttaagtgtcgctgatacgggtgtctatttctgtgcgagactgcccggtcctgcacctcgtgtggccccatttggtttaccggcacacaaatcagggcaagtcctacgacggtctc

SEQ ID NO: 451902 - DNA, 525 bp, Homo sapiens
  misc_feature: HEFZJCU01B9FQ3.16.27.C05.1.454.heavy.3.raw
  modified_base (518)..(518): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtnatcgtct

SEQ ID NO: 451903 - DNA, 488 bp, Homo sapiens; identical to SEQ ID NO: 444651
  misc_feature: HEFZJCU01AJ7VB.16.67.G01.1.454.heavy.3.raw

SEQ ID NO: 451904 - DNA, 490 bp, Homo sapiens; identical to SEQ ID NO: 451781
  misc_feature: HEFZJCU01AF289.11.13.B02.1.454.heavy.3.raw

SEQ ID NO: 451905 - DNA, 493 bp, Homo sapiens
  misc_feature: HEFZJCU01AV53Y.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtt

SEQ ID NO: 451906 - DNA, 537 bp, Homo sapiens
  misc_feature: HEFZJCU01D9JNY.52.73.G07.1.454.heavy.3.raw
cgcagtacgacacgaccggtgctcgatttagctctacgctcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgccctggcgctatggacgtctggggccaagggaccacggtcaccgtctcctcagcctccaccaaggcccatcggtcttcccctggcc

SEQ ID NO: 451907 - DNA, 389 bp, Homo sapiens
  misc_feature: HEFZJCU01AXW2E.52.34.D01.1.454.heavy.3.raw
cgcagtacgacacgaccggtgctcgatttagatcgtctgtgttgggtttgggtctcatttatcagtgatactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 451908 - DNA, 411 bp, Homo sapiens
  misc_feature: HEFZJCU01BNWSA.53.68.G02.1.454.heavy.3.raw
cgcgtatacacacgaccggtgctcgatttagtcgatagtgaagggaaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctactttgagtactggggccgcggagccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 451909 - DNA, 406 bp, Homo sapiens; identical to SEQ ID NO: 445177
  misc_feature: HEFZJCU01A1CP8.51.77.G11.1.454.heavy.3.raw

SEQ ID NO: 451910 - DNA, 498 bp, Homo sapiens
  misc_feature: HEFZJCU01BKK0N.8.25.C03.1.454.heavy.3.raw
ctcgcgtgtccacgaccggtgctcgatttagtagtgtagatttgggtttgggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaaatccgcaaaatgacctctggggccagggaaccctggtcaccgtctcctcagcctccaccaagggcccatcggtcttcccctggcgccctgctccaggagcacctccgagagcacagcggccctgggctgcctggtcaaggactacttccgacacgcgag

SEQ ID NO: 451911 - DNA, 518 bp, Homo sapiens; identical to SEQ ID NO: 444718
  misc_feature: HEFZJCU01AIDKE.9.34.D01.1.454.heavy.3.raw

SEQ ID NO: 451912 - DNA, 511 bp, Homo sapiens
  misc_feature: HEFZJCU01DZENE.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgtacctttctggtatttcgatctctggggccgtggcaccctggtcactgtctcctcggcttccaccaaggcccatcggtcttcccctggcgccctgctccaggagcacctctcggggcacagcgccg

SEQ ID NO: 451913 - DNA, 380 bp, Homo sapiens; identical to SEQ ID NO: 445304
  misc_feature: HEFZJCU01BPK2A.3.26.C04.1.454.heavy.3.raw

SEQ ID NO: 451914 - DNA, 511 bp, Homo sapiens
  misc_feature: HEFZJCU01DSOU4.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttcccctggcgccctgctccaggagcacctccgagagcacagcggccctggctgcctggtcaaggacta

SEQ ID NO: 451915 - DNA, 502 bp, Homo sapiens; identical to SEQ ID NO: 448699
  misc_feature: HEFZJCU01CTI5E.10.34.D01.1.454.heavy.3.raw

SEQ ID NO: 451916 - DNA, 517 bp, Homo sapiens
  misc_feature: HEFZJCU01C1H1I.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacgggccgtggtattactgtgttgagagatggggcccacgaacgttactacgctatggacgtctggggaccg

SEQ ID NO: 451917 - DNA, 503 bp, Homo sapiens
  misc_feature: HEFZJCU01DPT24.10.88.H11.1.454.heavy.3.raw
  modified_base (453)..(453): a, c, t, g, unknown or other
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtggtgggtgggtcagcgcttaccaagttggctacacgaaattatgcacagaagttccaggacagagtcaccatgaccacagacacatccacgagcacagcctacatggaactgaggagcctgagatctgacgacacggccgtatatttntgcgcgagagacgtaaaagtgacgtggtattccggggggacacgatgaac

SEQ ID NO: 451918 - DNA, 525 bp, Homo sapiens
  misc_feature: HEFZJCU01EF95M.9.37.D04.1.454.heavy.3.raw
tgatacgtctcacgaccggtgctcgatttagtagcatactgttgggtttgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggccgtatatcactgtgccaaagatcagaaggacggttcggggagttacaaatattactacttctactatggaatggacgtctggggccgagggaccacggtcaccgtctcctcagcctccaccaagggcccatcggtcttccccctggcaccctcctccaagagcacctctgggggcacagcggccctgggctgcctggtcaaggactacttccagacgtatca

SEQ ID NO: 451919 - DNA, 500 bp, Homo sapiens; identical to SEQ ID NO: 445720
  misc_feature: HEFZJCU01B3NGB.3.20.B09.1.454.heavy.3.raw

SEQ ID NO: 451920 - DNA, 506 bp, Homo sapiens
  misc_feature: HEFZJCU01B7W5E.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctggactgcctggtcaaggactacttccgagtagtaca

SEQ ID NO: 451921 - DNA, 482 bp, Homo sapiens
  misc_feature: HEFZJCU01BLCD4.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggccaccctcctccaagagcacctctgggggcacagcggcctgggctgcctggtcaaggactacttcctagagacacg

SEQ ID NO: 451922 - DNA, 485 bp, Homo sapiens
  misc_feature: HEFZJCU01ET1DD.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctggccgccctgctccaggagcacctccgagagcacagcggccctgggctgcctggtcaaggactacttcccactactatg

SEQ ID NO: 451923 - DNA, 495 bp, Homo sapiens
  misc_feature: HEFZJCU01CPB18.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaatcctagtggca

SEQ ID NO: 451924 - DNA, 514 bp, Homo sapiens
  misc_feature: HEFZJCU01EFSO1.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccccttcggccacccctccctccaagacgcacctctgggggcacagcggccctgggctcgcctggtcaaggactacttccgtactagacg

SEQ ID NO: 451925 - DNA, 423 bp, Homo sapiens; identical to SEQ ID NO: 444772
  misc_feature: HEFZJCU01E0CRT.16.78.H01.1.454.heavy.3.raw

SEQ ID NO: 451926 - DNA, 515 bp, Homo sapiens
  misc_feature: HEFZJCU01BIPKT.52.24.C02.1.454.heavy.3.raw
cgcagtacgacacgaccggtgctcgatttagtacagatcgttagggaaagggggagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaaggggctggagtgggtctcatttattagtactagttacttatactacgcagactcagtgaagggccgattcaccatctccagagacaacgccaggaattcactatatttgcaaatgaacagcctgcgagccgaggacacggctgtgtattactgtgcgcgagaacacagcaatggccatttcgactactggggccagggaaccct

SEQ ID NO: 451927 - DNA, 495 bp, Homo sapiens
  misc_feature: HEFZJCU01A6SZ0.40.81.H04.1.454.heavy.3.raw
tctagcgactcacgaccggtgctcgatttagtagtgtagattcgcggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgga

SEQ ID NO: 451928 - DNA, 520 bp, Homo sapiens
  misc_feature: HEFZJCU01CZK7P.48.58.F03.1.454.heavy.3.raw
agtatacatacacgaccggtgctcgatttagtctgatcgagaagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatcctgggccaggaaccctggtcaccgtctcctcagcctccacaacggcctacg

SEQ ID NO: 451929 - DNA, 509 bp, Homo sapiens; identical to SEQ ID NO: 445586
  misc_feature: HEFZJCU01DHIET.12.78.H01.1.454.heavy.3.raw

SEQ ID NO: 451930 - DNA, 537 bp, Homo sapiens
  misc_feature: HEFZJCU01ES5P2.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctcgtggggaccg

SEQ ID NO: 451931 - DNA, 537 bp, Homo sapiens
  misc_feature: HEFZJCU01DCQH6.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcacatctcagaagacaattccaggaacacattgtatcttcaaatgaataacctgagagccgaggacacggccatgtattactgtggtggggcatttacttgaccccgtgggggcccggggaaccctgggtcacccgtctccccgaccctccaacccg

SEQ ID NO: 451932 - DNA, 422 bp, Homo sapiens; identical to SEQ ID NO: 444681
  misc_feature: HEFZJCU01DW71P.16.78.H01.1.454.heavy.3.raw

SEQ ID NO: 451933 - DNA, 447 bp, Homo sapiens
  misc_feature: HEFZJCU01D1S3C.49.14.B03.1.454.heavy.3.raw
agtcgagagacacgaccggtgctcgatttagtgtgagtagttccgcgggcacgaccggtgctcgatttagtgagtcagtaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 451934 - DNA, 387 bp, Homo sapiens; identical to SEQ ID NO: 445229
  misc_feature: HEFZJCU01BN6X2.11.20.B09.1.454.heavy.3.raw

SEQ ID NO: 451935 - DNA, 494 bp, Homo sapiens
  misc_feature: HEFZJCU01EDOVV.52.53.E09.1.454.heavy.3.raw
cgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggccaccctcctccaagagcacctctggggcacagcggccctgggctgcctggtcaaggactacttcctatacgatcg

SEQ ID NO: 451936 - DNA, 481 bp, Homo sapiens
  misc_feature: HEFZJCU01BXB9J.18.26.C04.1.454.heavy.3.raw
tacgagtatgcacgaccggtgctcgatttagtctagcgactttgggtttgggtccctcagactctcctgtgcagcctctggattcaccttcagtaactactacatggcctggatccgccaggctccagggaaggggctggagtacgtctcatacatcagtaacactggaaataccatatactacgcagactctgtgaggggccgattcaccatcgccagggacaacgccaagagctcacattatctgcagatgactgccctgagagccgaggactcggccgtttactactgtgcgagagatcccggcgatgctggcaccggctggtactactttgattcctggggccagggaaccctggtcaccgtctcctcagcctccaccaagggccatcggtcttcccctggcgccctgctccaggagcacctccgagagcacagcggccctgggctgcctggtcaaggactacttcccatactcgta

SEQ ID NO: 451937 - DNA, 482 bp, Homo sapiens; identical to SEQ ID NO: 444503
  misc_feature: HEFZJCU01BM3XR.7.10.A10.1.454.heavy.3.raw

SEQ ID NO: 451938 - DNA, 509 bp, Homo sapiens
  misc_feature: HEFZJCU01DZT9Z.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgtcatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 451939 - DNA, 484 bp, Homo sapiens
  misc_feature: HEFZJCU01D7US7.48.34.D01.1.454.heavy.3.raw
agtatacatacacgaccggtgctcgatttagatcgtctgtgttgggtttggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 451940 - DNA, 520 bp, Homo sapiens
  misc_feature: HEFZJCU01BR7W2.52.37.D04.1.454.heavy.3.raw
cgcagtacgacacgaccggtgctcgatttagtagcatactgttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggttgttgtcgttgcaccagctgccctacccggctgctacttcgatctctggggccgtggcaccctggtcactgtcttctcagcctccaccaagggccccatcggtcttccccctggcaccctcctccaagagcacctctgggggcacagcggccctgggctgcctggtcaaggactacttcctatacga

SEQ ID NO: 451941 - DNA, 500 bp, Homo sapiens; identical to SEQ ID NO: 445720
  misc_feature: HEFZJCU01BPT0Q.3.20.B09.1.454.heavy.3.raw

SEQ ID NO: 451942 - DNA, 379 bp, Homo sapiens; identical to SEQ ID NO: 444450
  misc_feature: HEFZJCU01ARI3N.47.77.G11.1.454.heavy.3.raw

SEQ ID NO: 451943 - DNA, 489 bp, Homo sapiens; identical to SEQ ID NO: 444791
  misc_feature: HEFZJCU01A61RD.47.85.H08.1.454.heavy.3.raw

SEQ ID NO: 451944 - DNA, 501 bp, Homo sapiens
  misc_feature: HEFZJCU01EY7CR.52.70.G04.1.454.heavy.3.raw
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctatactgtgcgaggtcggcacgctgacaacctctacttctattcctacgctatggacgtctc

SEQ ID NO: 451945 - DNA, 487 bp, Homo sapiens
  misc_feature: HEFZJCU01BSERY.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctgcgcctgctccaggagcacctccgagagcacagcggccctgggctgcctggtcaaggactacttccacgagagta

SEQ ID NO: 451946 - DNA, 503 bp, Homo sapiens
  misc_feature: HEFZJCU01A9VLB.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 451947 - DNA, 379 bp, Homo sapiens; identical to SEQ ID NO: 444450
  misc_feature: HEFZJCU01EDQDK.47.77.G11.1.454.heavy.3.raw

SEQ ID NO: 451948 - DNA, 518 bp, Homo sapiens
  misc_feature: HEFZJCU01D90LJ.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatctttcaaatgaataacctgagagccgaggacacggccatgtattactgtgtggggcattacttgaccctggggcccggggaacctgggtcaccgtct

SEQ ID NO: 451949 - DNA, 505 bp, Homo sapiens
  misc_feature: HEFZJCU01CNI6U.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttccccctggcgccctgctccacggagcgacctcccgagagcacagcggccctcgggctggcctggtcaaggactaacttcctagtcgctaga

SEQ ID NO: 451950 - DNA, 426 bp, Homo sapiens
  misc_feature: HEFZJCU01ECT6F.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttcagacgtatca

SEQ ID NO: 451951 - DNA, 530 bp, Homo sapiens
  misc_feature: HEFZJCU01DCN7H.52.55.E11.1.454.heavy.3.raw
cgcagtacgacacgaccggtgctcgatttagcactcgcacgttgggtttggggtgagagaggagcccagccctgggattttcaggtgttttcatttggtgatcaggactgaacagagagaactcaccatggagtttgggctgagctggctttttcttgtggctattttaaaaggtgtccagtgtgaggtgcaactgttggagtctgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgccccttgactggttattcgactcctgggccaggaacct

SEQ ID NO: 451952 - DNA, 426 bp, Homo sapiens
  misc_feature: HEFZJCU01DNSKO.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctggggcacagcggccctgggctgcctggtcaaggactacttccagacgtatca

SEQ ID NO: 451953 - DNA, 513 bp, Homo sapiens
  misc_feature: HEFZJCU01CJIST.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtcccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccatttggtttaccggcacacaaatcagggcaagtcctacgacggtctggtacg

SEQ ID NO: 451954 - DNA, 384 bp, Homo sapiens; identical to SEQ ID NO: 444454
  misc_feature: HEFZJCU01CKE0S.11.61.F06.1.454.heavy.3.raw

SEQ ID NO: 451955 - DNA, 409 bp, Homo sapiens; identical to SEQ ID NO: 444519
  misc_feature: HEFZJCU01AGRCA.3.41.D08.1.454.heavy.3.raw

SEQ ID NO: 451956 - DNA, 514 bp, Homo sapiens
  misc_feature: HEFZJCU01B3FIU.53.85.H08.1.454.heavy.3.raw
cgcgtatacacacgaccggtgctcgatttagtatcactcagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaaactatggtgactccgtgaagggccgattctccgtctccagagacaattccaagaacaccttgtatctgcaaatgaacagcctgagatatgaggacacggctctgtattactgtgcgaaagaaaaggttactgtggaagagtgggagttattcgttggggaaggctttgatatctggggccaagggacagtggtcacagtctcttcagcctccaccaagggcccatcggtcttccccctggcaccctcctccaagagcacctctgggggcacagcggccctggggctgcctggtcaaggactacttcctcgtactgcg

SEQ ID NO: 451957 - DNA, 521 bp, Homo sapiens
  misc_feature: HEFZJCU01D4DTK.26.57.F02.1.454.heavy.3.raw
  modified_base (370)..(370): a, c, t, g, unknown or other
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaggctggagtggcttggccgtattagaaccaaacctgacaagtacgcgacaatttangctgcgtcggtgcaaggcaggttcaccatctccagagatgattcagagaacacggcgtatctgcaaatgaacagacctgaaaaccgaggacgacggccgtgtattactgtgccagacatccgtcgtattacgtatttttcagttggtcccg

SEQ ID NO: 451958 - DNA, 338 bp, Homo sapiens; identical to SEQ ID NO: 444472
  misc_feature: HEFZJCU01CKLVP.53.8.A08.1.454.heavy.3.raw

SEQ ID NO: 451959 - DNA, 488 bp, Homo sapiens; identical to SEQ ID NO: 444617
  misc_feature: HEFZJCU01EMK4W.4.6.A06.1.454.heavy.3.raw

SEQ ID NO: 451960 - DNA, 489 bp, Homo sapiens; identical to SEQ ID NO: 448298
  misc_feature: HEFZJCU01BGP5D.12.53.E09.1.454.heavy.3.raw

SEQ ID NO: 451961 - DNA, 519 bp, Homo sapiens
  misc_feature: HEFZJCU01C42IP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttcccctggcg

SEQ ID NO: 451962 - DNA, 519 bp, Homo sapiens; identical to SEQ ID NO: 446228
  misc_feature: HEFZJCU01DPN2B.9.43.D10.1.454.heavy.3.raw

SEQ ID NO: 451963 - DNA, 517 bp, Homo sapiens
  misc_feature: HEFZJCU01CYQCB.26.71.G05.1.454.heavy.3.raw
agactatactcacgaccggtgctcgatttagtgtcgtcgcaagagagaggggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactacttcc

SEQ ID NO: 451964 - DNA, 506 bp, Homo sapiens; identical to SEQ ID NO: 446520
  misc_feature: HEFZJCU01DZZXE.10.38.D05.1.454.heavy.3.raw

SEQ ID NO: 451965 - DNA, 511 bp, Homo sapiens; identical to SEQ ID NO: 447160
  misc_feature: HEFZJCU01CCD0Y.14.25.C03.1.454.heavy.3.raw

SEQ ID NO: 451966 - DNA, 498 bp, Homo sapiens; identical to SEQ ID NO: 445952
  misc_feature: HEFZJCU01BFXQN.11.71.G05.1.454.heavy.3.raw

SEQ ID NO: 451967 - DNA, 500 bp, Homo sapiens
  misc_feature: HEFZJCU01C2P99.52.70.G04.1.454.heavy.3.raw
  modified_base (337)..(337): a, c, t, g, unknown or other
  modified_base (444)..(444): a, c, t, g, unknown or other
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaggtgacaaaagtnttcacagaagttccagggcagagtcaccattaccagcgacgcatccgcgaacacagcctatatggaactcagcagcctgagatctgaagacacggctgtctattacngtgcgagggtcgcacgctgacaacctcttacttctattcctagctatggacgtctc

SEQ ID NO: 451968 - DNA, 506 bp, Homo sapiens
  misc_feature: HEFZJCU01DY1TU.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtgggccgtac

SEQ ID NO: 451969 - DNA, 489 bp, Homo sapiens
  misc_feature: HEFZJCU01ERK8J.48.20.B09.1.454.heavy.3.raw
agtatacatacacgaccggtgctcgatttagtgtagtgtgaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 451970 - DNA, 491 bp, Homo sapiens; identical to SEQ ID NO: 445531
  misc_feature: HEFZJCU01AV99Y.11.38.D05.1.454.heavy.3.raw

SEQ ID NO: 451971 - DNA, 512 bp, Homo sapiens
  misc_feature: HEFZJCU01B5WPK.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggtacccg

SEQ ID NO: 451972 - DNA, 513 bp, Homo sapiens
  misc_feature: HEFZJCU01A1LKM.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtggacacagccacatattactgttcacgctctatggttcggggagttattagtccctactttgactactgggccagggaactctggtcaccgtctccgcagcctccaccaagggccc

SEQ ID NO: 451973 - DNA, 522 bp, Homo sapiens; identical to SEQ ID NO: 446788
  misc_feature: HEFZJCU01DNHLX.12.40.D07.1.454.heavy.3.raw

SEQ ID NO: 451974 - DNA, 502 bp, Homo sapiens
  misc_feature: HEFZJCU01BNZ2I.49.57.F02.1.454.heavy.3.raw
agtcgagagacacgaccggtgctcgatttagctcgatatagttgggtttggggctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagattt

SEQ ID NO: 451975 - DNA, 537 bp, Homo sapiens
  misc_feature: HEFZJCU01DQ75J.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagttggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattgggggccagggagccctggtccaccg

SEQ ID NO: 451976 - DNA, 517 bp, Homo sapiens
  misc_feature: HEFZJCU01A9HUH.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgacgaaagcaccggcagttagtccaccctatactactttgactacgtcggggaccaac

SEQ ID NO: 451977 - DNA, 512 bp, Homo sapiens
  misc_feature: HEFZJCU01AGGJR.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactactt

SEQ ID NO: 451978 - DNA, 495 bp, Homo sapiens
  misc_feature: HEFZJCU01ETEJ0.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccacaggccatcggtcttcccctggcgccctgctccaggagcacctcgtgggggcacagcggcccgtgggctgcctggtcaaggactacttcctacgtcgtat

SEQ ID NO: 451979 - DNA, 464 bp, Homo sapiens
  misc_feature: HEFZJCU01B82DT.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacgggggaaaattggggccagggaaccctggtctccgtctcgtcagcctccaccaagggcccatcggtcttccccctggcgccctgctccaggagcacctccgagacgcacagcggccctgggctgcctggtcaaggactacttcccacgagagta

SEQ ID NO: 451980 - DNA, 512 bp, Homo sapiens; identical to SEQ ID NO: 445688
  misc_feature: HEFZJCU01EN8D3.3.34.D01.1.454.heavy.3.raw

SEQ ID NO: 451981 - DNA, 500 bp, Homo sapiens
  misc_feature: HEFZJCU01ENC9S.13.11.A11.1.454.heavy.3.raw
tcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggatcgaggacacggccttgtatttctgtgcgaggttagcagtggctggtacttacgct

SEQ ID NO: 451982 - DNA, 491 bp, Homo sapiens; identical to SEQ ID NO: 444592
  misc_feature: HEFZJCU01A4986.11.26.C04.1.454.heavy.3.raw

SEQ ID NO: 451983 - DNA, 378 bp, Homo sapiens; identical to SEQ ID NO: 444463
  misc_feature: HEFZJCU01B3CUM.47.77.G11.1.454.heavy.3.raw

SEQ ID NO: 451984 - DNA, 477 bp, Homo sapiens
  misc_feature: HEFZJCU01C2Z25.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggccaccctcctccaagagcacctcgtgggggcacagcggcctgggctgcctggtcaaggactacttccgagtagtaca

SEQ ID NO: 451985 - DNA, 530 bp, Homo sapiens
  misc_feature: HEFZJCU01EPVF4.53.33.C11.1.454.heavy.3.raw
  modified_base (281)..(281): a, c, t, g, unknown or other
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacngaaacctgagagctgaagacacggctgtgtattactgtgcgagtgagatgtcttactatgatgccagtggtttggtaccgttcgacccctcggggccgagggaaccctggtcaccgtctcctcagcttccaccaagggcccatcggtcttcccctcggcgccctcgctccacggagcacctctgggggcgacgagcggccccgtcggggcgtggcctggtcgaaggacgtaaccttcccttccgttacc

SEQ ID NO: 451986 - DNA, 470 bp, Homo sapiens; identical to SEQ ID NO: 444866
  misc_feature: HEFZJCU01B7US4.4.36.D03.1.454.heavy.3.raw

SEQ ID NO: 451987 - DNA, 499 bp, Homo sapiens
  misc_feature: HEFZJCU01DRHC6.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactaaggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggacccgat

SEQ ID NO: 451988 - DNA, 500 bp, Homo sapiens; identical to SEQ ID NO: 447174
  misc_feature: HEFZJCU01BX62Y.7.76.G10.1.454.heavy.3.raw

SEQ ID NO: 451989 - DNA, 396 bp, Homo sapiens; identical to SEQ ID NO: 444469
  misc_feature: HEFZJCU01CN3II.47.46.E02.1.454.heavy.3.raw

SEQ ID NO: 451990 - DNA, 503 bp, Homo sapiens; identical to SEQ ID NO: 450415
  misc_feature: HEFZJCU01DCPMD.15.55.E11.1.454.heavy.3.raw

SEQ ID NO: 451991 - DNA, 499 bp, Homo sapiens
  misc_feature: HEFZJCU01ELL00.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgaccctggggccagggaaccctggtcgtcgtctcgtctgcctccaccaagggcccatcggtcttcccctggcgccctgctccaggagcacctccgagagcacagcggccctgggctgcctggtcaaggactacttccgtactagacg

SEQ ID NO: 451992 - DNA, 392 bp, Homo sapiens
  misc_feature: HEFZJCU01AOVKT.49.60.F05.1.454.heavy.3.raw
agtcgagagacacgaccggtgctcgatttagtacgtcatcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 451993 - DNA, 500 bp, Homo sapiens; identical to SEQ ID NO: 444529
  misc_feature: HEFZJCU01CRSME.12.38.D05.1.454.heavy.3.raw

SEQ ID NO: 451994 - DNA, 516 bp, Homo sapiens
  misc_feature: HEFZJCU01DC22X.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctgggggtccctgagactctcctgtcaagcctctgggttcagcttcagtgtatattggatgagctgggtccgccagactccagggaaggggctggagtggggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccgggggaaccctggtcaccgtcgaa

SEQ ID NO: 451995 - DNA, 531 bp, Homo sapiens; identical to SEQ ID NO: 446857
  misc_feature: HEFZJCU01ENQJA.7.78.H01.1.454.heavy.3.raw

SEQ ID NO: 451996 - DNA, 493 bp, Homo sapiens
  misc_feature: HEFZJCU01CG4WP.14.58.F03.1.454.heavy.3.raw
cgtctagtaccacgaccggtgctcgatttagtctgatcgagaagggaaaggggctgggagaggagcccagcactagaagtcggcggtgtttccattcggtgatcagcactgaacacagaggactcactatggagtttgggctgagctgggttttcctcgctgctcttttaagaggtgtccagtgtgaggtgcagctggtggagtctgggggaggcgtggtccagcctgggaggtccctgagactctcctgtgcagcctctggattcaccttcgataattatgacatagactgggtccgccaggctccaggcagggggctggagtgggtggcaataatatcatatgatgggagcaataaatattatgaagactctgtgaagggccgattcaccatctccagagacaattccaagaacacggtatatttggaaatgaacagcctgagaggtgacgacacggctgtgtattattgtgcgaaagagatgtggcgctt

SEQ ID NO: 451997 - DNA, 514 bp, Homo sapiens
  misc_feature: HEFZJCU01ELLRH.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaattttggactcgtcattctccctttgacttctggggccagggaaccctagtcaccgttcc

SEQ ID NO: 451998 - DNA, 383 bp, Homo sapiens
  misc_feature: HEFZJCU01C2YKV.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggccaggggacaatggtaaccgtctcttcagcctccaccaagggcccatcggtcttccccctggcgccctgctccaggagcacctccgagagcacagcggccctgggctgcctggtcaaggactacttccgtatctctcg

SEQ ID NO: 451999 - DNA, 490 bp, Homo sapiens
  misc_feature: HEFZJCU01A88N4.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgagggccgattcaccatctccagagacaattcccagaacacggtctatctgcacctgaccagcctgagaactgacgacacgtctctctactactgtgtgagagagttgacgagt

SEQ ID NO: 452000 - DNA, 390 bp, Homo sapiens; identical to SEQ ID NO: 446017
  misc_feature: HEFZJCU01BKSDB.51.46.E02.1.454.heavy.3.raw

SEQ ID NO: 452001 - DNA, 526 bp, Homo sapiens
  misc_feature: HEFZJCU01D7D93.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctcgctccaggagcacctccgacgagcacagcggccctgggc

SEQ ID NO: 452002 - DNA, 437 bp, Homo sapiens
  misc_feature: HEFZJCU01BUG8J.49.34.D01.1.454.heavy.3.raw
agtcgagagacacgaccggtgctcgatttagatcgtctgtgttgggtttgggtgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 452003 - DNA, 323 bp, Homo sapiens
  misc_feature: HEFZJCU01EAAOP.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattgggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 452004 - DNA, 492 bp, Homo sapiens; identical to SEQ ID NO: 446798
  misc_feature: HEFZJCU01C9K2N.19.53.E09.1.454.heavy.3.raw

SEQ ID NO: 452005 - DNA, 527 bp, Homo sapiens
  misc_feature: HEFZJCU01BTYY4.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 452006 - DNA, 490 bp, Homo sapiens; identical to SEQ ID NO: 449510
  misc_feature: HEFZJCU01CJBWG.40.85.H08.1.454.heavy.3.raw

SEQ ID NO: 452007 - DNA, 488 bp, Homo sapiens
  misc_feature: HEFZJCU01CQPNN.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgtccttgattacta

SEQ ID NO: 452008 - DNA, 538 bp, Homo sapiens
  misc_feature: HEFZJCU01EMJ7X.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttacaaatgaataacctgagagccgaggacacggccatgtaattactgtgtggggctatttacttgaccccgtgggggcccggggaaccctggtccaccgtcctccccaccctccaaccg

SEQ ID NO: 452009 - DNA, 396 bp, Homo sapiens
  misc_feature: HEFZJCU01CKAYQ.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggttgcctggtcaaggactacttcctacgtgagct

SEQ ID NO: 452010 - DNA, 481 bp, Homo sapiens; identical to SEQ ID NO: 448685
  misc_feature: HEFZJCU01CNDCU.7.10.A10.1.454.heavy.3.raw

SEQ ID NO: 452011 - DNA, 523 bp, Homo sapiens
  misc_feature: HEFZJCU01AG49O.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggccaggggaccctggtcatcgtctccccagccctccaccaagggcccatcggtcttccccctggccg

SEQ ID NO: 452012 - DNA, 503 bp, Homo sapiens
  misc_feature: HEFZJCU01BJV0E.22.86.H09.1.454.heavy.3.raw
acatacgcgtcacgaccggtgctcgatttagtgctatagacttgggtttgggctgagcgtggttttccgtcgttaggctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgcctgctcc

SEQ ID NO: 452013 - DNA, 396 bp, Homo sapiens; identical to SEQ ID NO: 444469
  misc_feature: HEFZJCU01BR52C.47.46.E02.1.454.heavy.3.raw

SEQ ID NO: 452014 - DNA, 494 bp, Homo sapiens
  misc_feature: HEFZJCU01EAWMJ.13.11.A11.1.454.heavy.3.raw
tcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcatctttgatgattatgccatgcactgggtccggcaagctccagggaagggcctggagtgggtctcaggtattagttggaatagtggtaacataggctatgcggactctgtgaagggccgattcaccatctccagagacaacgccaagaactccctgtatctgcaaatgaacagtctgagagctgaggacacggccttgtattactgtgcaaaaggtccatttagcagtggctc

SEQ ID NO: 452015 - DNA, 362 bp, Homo sapiens; identical to SEQ ID NO: 444925
  misc_feature: HEFZJCU01E164H.49.25.C03.1.454.heavy.3.raw

SEQ ID NO: 452016 - DNA, 492 bp, Homo sapiens
  misc_feature: HEFZJCU01CDHDK.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcaccttttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 452017 - DNA, 493 bp, Homo sapiens
  misc_feature: HEFZJCU01BWL1U.49.37.D04.1.454.heavy.3.raw
agtcgagagacacgaccggtgctcgatttagtagcatactgttgggtttggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccagggaaccctagtcaccgtctcctcagcctccaccaagggcccatcggtcttcccctggcaccctcctccaagagcacctctgggggcacagcggccctgggctgcctggtcaaggactacttcctctctcgact

SEQ ID NO: 452018 - DNA, 371 bp, Homo sapiens; identical to SEQ ID NO: 444435
  misc_feature: HEFZJCU01D9HW1.3.42.D09.1.454.heavy.3.raw

SEQ ID NO: 452019 - DNA, 497 bp, Homo sapiens
  misc_feature: HEFZJCU01AFUHI.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactggtgggagaaatcctagtggca

SEQ ID NO: 452020 - DNA, 513 bp, Homo sapiens
  misc_feature: HEFZJCU01D61HJ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccatactatggggcttgttctgggcagggacctggtcatcgtctcccagcctccaccaaggccatcggtcttcccctggccg

SEQ ID NO: 452021 - DNA, 511 bp, Homo sapiens
  misc_feature: HEFZJCU01DZKV8.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccgggaacctggtcacgtcaa

SEQ ID NO: 452022 - DNA, 518 bp, Homo sapiens
  misc_feature: HEFZJCU01CV6RR.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggagcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 452023 - DNA, 392 bp, Homo sapiens
  misc_feature: HEFZJCU01A09FN.49.46.E02.1.454.heavy.3.raw
agtcgagagacacgaccggtgctcgatttagactcatctacagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttccttctcgact

SEQ ID NO: 452024 - DNA, 508 bp, Homo sapiens; identical to SEQ ID NO: 445911
  misc_feature: HEFZJCU01DYK9S.12.78.H01.1.454.heavy.3.raw

SEQ ID NO: 452025 - DNA, 539 bp, Homo sapiens
  misc_feature: HEFZJCU01DGLDO.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgctttgatatctggggcccagggac

SEQ ID NO: 452026 - DNA, 509 bp, Homo sapiens
  misc_feature: HEFZJCU01EAQFD.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtccagctgcagctgcaggagtcgggcccaggactggtgaagccttcggagaccctgtccctcacctgcactgtctctggtgactccatcagcagtagtacttactactgggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccg

SEQ ID NO: 452027 - DNA, 520 bp, Homo sapiens; identical to SEQ ID NO: 450321
  misc_feature: HEFZJCU01DXOOK.9.34.D01.1.454.heavy.3.raw

SEQ ID NO: 452028 - DNA, 429 bp, Homo sapiens
  misc_feature: HEFZJCU01ENDTC.2.46.E02.1.454.heavy.3.raw
acgctcgacacacgaccggtgctcgatttagactcatctacagggaaaggggctggagtggattggggaaatcaatcattttcgaggcaccacttacaacccgtccctcaagagtcgagtcaccattgcagtggacaggtccaagaaccagttttccctgaacttgaactctgtgaccgccgcggacacggctgtgtattactgtgcgagaggcgaattacccggtactgcgacacaccaagatcagctggtccgaaggctacttcgttactacggcatggacgtctggggccaagggaccacggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 452029 - DNA, 465 bp, Homo sapiens
  misc_feature: HEFZJCU01DFZ3A.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttccccctggcgccctgctccaggagcacctccgagagcacagccggccctgggctgcctggtcaaggactacttcccacgagagta

SEQ ID NO: 452030 - DNA, 482 bp, Homo sapiens; identical to SEQ ID NO: 444503
  misc_feature: HEFZJCU01DVME9.7.10.A10.1.454.heavy.3.raw

SEQ ID NO: 452031 - DNA, 505 bp, Homo sapiens
  misc_feature: HEFZJCU01ESZFO.52.33.C11.1.454.heavy.3.raw
cgcagtacgacacgaccggtgctcgatttagagtgagctcgttgggtttgggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctattattactgtgcgagagggaagtgggatattgtggcagctccaggtcgcccagcccggcccccttacg

SEQ ID NO: 452032 - DNA, 482 bp, Homo sapiens
  misc_feature: HEFZJCU01A4420.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcaggggtcaccatgaccagggacacgtccatcagcacgtccatcagcacagcctacatggacctgagcggcctgacatctgacgacacggccgtatatttctgtgcgagggagta

SEQ ID NO: 452033 - DNA, 526 bp, Homo sapiens
  misc_feature: HEFZJCU01EZBO7.10.85.H08.1.454.heavy.3.raw
catagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctccgagagcacagcggccctgggctgcctggtcaaggactacttcccactactat

SEQ ID NO: 452034 - DNA, 525 bp, Homo sapiens; identical to SEQ ID NO: 447122
  misc_feature: HEFZJCU01DO3CQ.14.55.E11.1.454.heavy.3.raw

SEQ ID NO: 452035 - DNA, 483 bp, Homo sapiens; identical to SEQ ID NO: 444924
  misc_feature: HEFZJCU01AF05X.10.35.D02.1.454.heavy.3.raw

SEQ ID NO: 452036 - DNA, 522 bp, Homo sapiens
  misc_feature: HEFZJCU01DMJA9.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccagtcggtcttcccctggcg

SEQ ID NO: 452037 - DNA, 336 bp, Homo sapiens; identical to SEQ ID NO: 444429
  misc_feature: HEFZJCU01A8FXY.14.28.C06.1.454.heavy.3.raw

SEQ ID NO: 452038 - DNA, 517 bp, Homo sapiens
  misc_feature: HEFZJCU01EMSK5.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttgggggccggggaaccctggtccaccgtcaaa

SEQ ID NO: 452039 - DNA, 437 bp, Homo sapiens; identical to SEQ ID NO: 444603
  misc_feature: HEFZJCU01CH6JW.3.21.B10.1.454.heavy.3.raw

SEQ ID NO: 452040 - DNA, 497 bp, Homo sapiens; identical to SEQ ID NO: 450948
  misc_feature: HEFZJCU01ASBQL.53.80.H03.1.454.heavy.3.raw

SEQ ID NO: 452041 - DNA, 484 bp, Homo sapiens
  misc_feature: HEFZJCU01AMQ8N.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggacgcacctccgagagcacagcggcctgggctgcctggtcaaggactacttcctacgtga

SEQ ID NO: 452042 - DNA, 496 bp, Homo sapiens
  misc_feature: HEFZJCU01APK3H.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctggggcacagcggccctgggctgcctggtcaaggactacttcctacgtcgtat

SEQ ID NO: 452043 - DNA, 423 bp, Homo sapiens; identical to SEQ ID NO: 444772
  misc_feature: HEFZJCU01DYYCJ.16.78.H01.1.454.heavy.3.raw

SEQ ID NO: 452044 - DNA, 489 bp, Homo sapiens
  misc_feature: HEFZJCU01DPAE8.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcagcctccaccaagggcccatcggtcttcccctggccgccctgctccaggagcacctccgagagcacagcggccctgggctgcctggtcaaggactacttccatactcgta

SEQ ID NO: 452045 - DNA, 506 bp, Homo sapiens
  misc_feature: HEFZJCU01B0M9F.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccgggacgacgtccatcgccacgacttacatggaactgaccagtctgacatttgacgacacggccgtctattactgtgcgacagaagcggcggacagaggttcgcttactggttcgaggct

SEQ ID NO: 452046 - DNA, 523 bp, Homo sapiens
  misc_feature: HEFZJCU01DT58F.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaggactacttcc

SEQ ID NO: 452047 - DNA, 496 bp, Homo sapiens
  misc_feature: HEFZJCU01D06DR.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggactct

SEQ ID NO: 452048 - DNA, 374 bp, Homo sapiens
  misc_feature: HEFZJCU01EYL6Y.13.59.F04.1.454.heavy.3.raw
tcacgtactacacgaccggtgctcgatttagtacacacacttagggattggggaaatctatcatagtgggaccacctactacagcccgtccctcaatagtcgcgtcaccatgtcagtggacgagcccaagaaccagttcttcctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttcccctggcgccctgctccaggagcacctccgagagcacagcggccctgggctgcctggtcaaggactacttcctagtacgtga

SEQ ID NO: 452049 - DNA, 523 bp, Homo sapiens
  misc_feature: HEFZJCU01DULD6.48.5.A05.1.454.heavy.3.raw
agtatacatacacgaccggtgctcgatttagatagatagacaggggagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctattctgcaaatgaacagcctgagagtcgacgacacggccgtatactactgtgcgagacagatgctgccgcctgttccgtgggccagggaaccctggtcaccgtctcctcacg

SEQ ID NO: 452050 - DNA, 525 bp, Homo sapiens
  misc_feature: HEFZJCU01EBCHL.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgatgacactgtccgttttattttgtacgagagcgtcgtctgtcagtggaattgactactggggccagggaaccctggtcaccgtctcctcagcctcc

SEQ ID NO: 452051 - DNA, 523 bp, Homo sapiens; identical to SEQ ID NO: 446270
  misc_feature: HEFZJCU01EGY0E.12.40.D07.1.454.heavy.3.raw

SEQ ID NO: 452052 - DNA, 396 bp, Homo sapiens; identical to SEQ ID NO: 444574
  misc_feature: HEFZJCU01EVIRJ.47.46.E02.1.454.heavy.3.raw

SEQ ID NO: 452053 - DNA, 522 bp, Homo sapiens
  misc_feature: HEFZJCU01AKQF9.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctggggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtactcctttgacgtctggggcc

SEQ ID NO: 452054 - DNA, 399 bp, Homo sapiens
  misc_feature: HEFZJCU01BBTRP.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcaccctcctccaagagcacctctgggggcacagcggccctgggctgcctggtcaagactacttcctacgtgagct

SEQ ID NO: 452055 - DNA, 396 bp, Homo sapiens; identical to SEQ ID NO: 444433
  misc_feature: HEFZJCU01D7L37.47.59.F04.1.454.heavy.3.raw

SEQ ID NO: 452056 - DNA, 423 bp, Homo sapiens; identical to SEQ ID NO: 444772
  misc_feature: HEFZJCU01EPL1M.16.78.H01.1.454.heavy.3.raw

SEQ ID NO: 452057 - DNA, 471 bp, Homo sapiens
  misc_feature: HEFZJCU01DFS4S.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatattctgt

SEQ ID NO: 452058 - DNA, 375 bp, Homo sapiens; identical to SEQ ID NO: 444459
  misc_feature: HEFZJCU01ES32Z.48.59.F04.1.454.heavy.3.raw

SEQ ID NO: 452059 - DNA, 510 bp, Homo sapiens
  misc_feature: HEFZJCU01EWKP4.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctgggtcaccgtctcctcagcctccaccaagggcccatcggtcttcccctggccgccctgctccaggagcacctccgagagcacagcggccctgggctgcctggtcaaggactacttccagacgtatca

SEQ ID NO: 452060 - DNA, 521 bp, Homo sapiens
  misc_feature: HEFZJCU01CJXV0.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagcgtgggttttccttgttagttattctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctgggtccaccgtctcctca

SEQ ID NO: 452061 - DNA, 379 bp, Homo sapiens; identical to SEQ ID NO: 444450
  misc_feature: HEFZJCU01B3UXR.47.77.G11.1.454.heavy.3.raw

SEQ ID NO: 452062 - DNA, 413 bp, Homo sapiens
  misc_feature: HEFZJCU01DA5ZA.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 452063 - DNA, 506 bp, Homo sapiens
  misc_feature: HEFZJCU01EHKFN.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcct

SEQ ID NO: 452064 - DNA, 380 bp, Homo sapiens; identical to SEQ ID NO: 444644
  misc_feature: HEFZJCU01EEWEN.9.53.E09.1.454.heavy.3.raw

SEQ ID NO: 452065 - DNA, 532 bp, Homo sapiens
  misc_feature: HEFZJCU01A67XS.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaaccctggtcaccgtctcctcagcctccaccaagggcccatcggtcttcccctggccaccctcctccc

SEQ ID NO: 452066 - DNA, 413 bp, Homo sapiens; identical to SEQ ID NO: 444933
  misc_feature: HEFZJCU01DRGVQ.51.60.F05.1.454.heavy.3.raw

SEQ ID NO: 452067 - DNA, 462 bp, Homo sapiens
  misc_feature: HEFZJCU01BUSMC.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacgggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 452068 - DNA, 495 bp, Homo sapiens
  misc_feature: HEFZJCU01DV6G7.40.55.E11.1.454.heavy.3.raw
tctagcgactcacgaccggtgctcgatttagcactcgcacgttgggtttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgccttgatatgtgggccaagggacaat

SEQ ID NO: 452069 - DNA, 497 bp, Homo sapiens
  misc_feature: HEFZJCU01BSSZP.22.86.H09.1.454.heavy.3.raw
acatacgcgtcacgaccggtgctcgatttagtgctatagacttgggtttgggctgagcgtggtttcgtcgttaggctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaacgggcccatcggtccttcccctggcgcct

SEQ ID NO: 452070 - DNA, 499 bp, Homo sapiens
  misc_feature: HEFZJCU01DEBPV.48.59.F04.1.454.heavy.3.raw
agtatacatacacgaccggtgctcgatttagtacacacacttagggattggggacccaacaaccacatccctcctcagaaggccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaatcgtgta

SEQ ID NO: 452071 - DNA, 524 bp, Homo sapiens
  misc_feature: HEFZJCU01EHJZZ.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttaggaaatgaacagcctaagtcctagaggacacgggtgtatactactagtacgaaggaggggggaacgaggcgggagttccaagtactcctttgacgtcgtggggccgtac

SEQ ID NO: 452072 - DNA, 463 bp, Homo sapiens; identical to SEQ ID NO: 446208
  misc_feature: HEFZJCU01CFUIP.19.10.A10.1.454.heavy.3.raw

SEQ ID NO: 452073 - DNA, 510 bp, Homo sapiens
  misc_feature: HEFZJCU01CL7TC.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggcgattcaccatctccagagacaattccaggaacacaatgtatttggagctgaacagcctaagtcctgaggacacgggcgtatactactgtacgaaggaggggggaaccgagcggagtcaagtactctttgtacg

SEQ ID NO: 452074 - DNA, 502 bp, Homo sapiens
  misc_feature: HEFZJCU01A9B36.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttcccctggcgccctgctccaggagcacctccgagagcacagcggccctgggctgcctggtcaaggactactcccactacta

SEQ ID NO: 452075 - DNA, 500 bp, Homo sapiens
  misc_feature: HEFZJCU01DC42F.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggccatcggtcttcccctggcgccctgctccaggagcacctccgagagcacagcggccctgggctgcctggtcaaggactacttcctatgtatact

SEQ ID NO: 452076 - DNA, 362 bp, Homo sapiens
  misc_feature: HEFZJCU01EKSKJ.3.67.G01.1.454.heavy.3.raw
agacgcactccacgaccggtgctcgatttagagtatacatattgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 452077 - DNA, 498 bp, Homo sapiens; identical to SEQ ID NO: 448922
  misc_feature: HEFZJCU01B47W8.11.73.G07.1.454.heavy.3.raw

SEQ ID NO: 452078 - DNA, 510 bp, Homo sapiens; identical to SEQ ID NO: 447226
  misc_feature: HEFZJCU01B8P3E.12.78.H01.1.454.heavy.3.raw

SEQ ID NO: 452079 - DNA, 509 bp, Homo sapiens; identical to SEQ ID NO: 445824
  misc_feature: HEFZJCU01CUNDE.9.14.B03.1.454.heavy.3.raw

SEQ ID NO: 452080 - DNA, 396 bp, Homo sapiens; identical to SEQ ID NO: 444426
  misc_feature: HEFZJCU01CC5G5.18.31.C09.1.454.heavy.3.raw

SEQ ID NO: 452081 - DNA, 510 bp, Homo sapiens
  misc_feature: HEFZJCU01EWD14.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggccatcggtcttcccctggcgccctgctccaggagcacctccgagagcacagcggccctggg

SEQ ID NO: 452082 - DNA, 379 bp, Homo sapiens; identical to SEQ ID NO: 444450
  misc_feature: HEFZJCU01COSFZ.47.77.G11.1.454.heavy.3.raw

SEQ ID NO: 452083 - DNA, 416 bp, Homo sapiens
  misc_feature: HEFZJCU01E0K5P.14.74.G08.1.454.heavy.3.raw
cgtctagtaccacgaccggtgctcgatttagtagctctatcagggaagggactggagtggattggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaggtcgttctgcacatattgttaggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacg

SEQ ID NO: 452084 - DNA, 379 bp, Homo sapiens; identical to SEQ ID NO: 444450
  misc_feature: HEFZJCU01DZUX8.47.77.G11.1.454.heavy.3.raw

SEQ ID NO: 452085 - DNA, 383 bp, Homo sapiens; identical to SEQ ID NO: 451998
  misc_feature: HEFZJCU01DSCSY.11.61.F06.1.454.heavy.3.raw

SEQ ID NO: 452086 - DNA, 488 bp, Homo sapiens; identical to SEQ ID NO: 444617
  misc_feature: HEFZJCU01BANR4.4.6.A06.1.454.heavy.3.raw

SEQ ID NO: 452087 - DNA, 508 bp, Homo sapiens; identical to SEQ ID NO: 451458
  misc_feature: HEFZJCU01BOF93.9.78.H01.1.454.heavy.3.raw

SEQ ID NO: 452088 - DNA, 491 bp, Homo sapiens
  misc_feature: HEFZJCU01B0S5O.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccggagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 452089 - DNA, 486 bp, Homo sapiens
  misc_feature: HEFZJCU01A9XK0.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaaccgagtggaggtggtgcagagtacgcccagaggtttcagggcagagtctccatgaccagtgacacgtccgcgagcactgtctatatggagatgaggagcctgagacttgacgacacggccgtatattactgtgcgagatcgaagaggtggctacaatcac

SEQ ID NO: 452090 - DNA, 516 bp, Homo sapiens
  misc_feature: HEFZJCU01EQMLO.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccgagggaaggggctggaatgggtctcaggtattactggtggtggttataccacatactacgcagactccgtgaacgggccggttcaccatctccagagacaattccaagaacacactgtatctgcaaatgaacagcctgagagccgacgacacggccatatattactgtgcgaaagcaccggcagttagtcacccatactactttgactacgtggggccg

SEQ ID NO: 452091 - DNA, 464 bp, Homo sapiens; identical to SEQ ID NO: 445533
  misc_feature: HEFZJCU01DT4SQ.19.10.A10.1.454.heavy.3.raw

SEQ ID NO: 452092 - DNA, 525 bp, Homo sapiens
  misc_feature: HEFZJCU01DYX2Y.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccctggggccagggaaccctggtcaccgtctcctcagcctccaccg

SEQ ID NO: 452093 - DNA, 338 bp, Homo sapiens; identical to SEQ ID NO: 444423
  misc_feature: HEFZJCU01CQTIM.47.38.D05.1.454.heavy.3.raw

SEQ ID NO: 452094 - DNA, 499 bp, Homo sapiens
  misc_feature: HEFZJCU01DULFB.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttgtggctaccgcggggctgaccactgggaccg

SEQ ID NO: 452095 - DNA, 476 bp, Homo sapiens
  misc_feature: HEFZJCU01AUBU0.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggcctgggctgcctggtcaaggactacttccgagtagtaca

SEQ ID NO: 452096 - DNA, 534 bp, Homo sapiens
  misc_feature: HEFZJCU01EL4LD.8.5.A05.1.454.heavy.3.raw
ctcgcgtgtccacgaccggtgctcgatttagatagatagacagggtctccgaaggcttcaccagtcctgtcccagctgcagctgcgtgagtcgggcccaggactggtgaagccttcggagaccctgtcgctcacctgcattgtctctggtggctccgtcagcagtagtaattattattggggctggatccgccagtcccccgggaaggggctggagtggattgggagtgtcttcgataatgggtacacttacaacaacccgtccctcaagagtcgagtcaccatatcagtaaacacgtccaagaaccagttctccctggacttgacctctgtgaccgccgcggacacggccgtttactattgtgcgagaggggaggatattgaagtagcaccacctccgtcggtcttcgatccctggggccgtggcaccctggtcactgtctcctcagcctccaccaagggcccatcggtcttcccctggcaccctcctccaagagcacctctgggggcacagcggccctgggctgcctggtcg

SEQ ID NO: 452097 - DNA, 410 bp, Homo sapiens
  misc_feature: HEFZJCU01AHA98.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 452098 - DNA, 500 bp, Homo sapiens
  misc_feature: HEFZJCU01BWELR.11.21.B10.1.454.heavy.3.raw
cgagagataccacgaccggtgctcgatttagtgtcgtcgcaagagaggaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtac

SEQ ID NO: 452099 - DNA, 497 bp, Homo sapiens
  misc_feature: HEFZJCU01B9SDG.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaat

SEQ ID NO: 452100 - DNA, 510 bp, Homo sapiens
  misc_feature: HEFZJCU01CABLN.3.34.D01.1.454.heavy.3.raw
agacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggatacttccgagtgcgtct

SEQ ID NO: 452101 - DNA, 512 bp, Homo sapiens
  misc_feature: HEFZJCU01A3MXC.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgaccacggccatatattactgtgcgaaagcaccggcagttagtcacccatactactttgactacgtggggccg

SEQ ID NO: 452102 - DNA, 533 bp, Homo sapiens
  misc_feature: HEFZJCU01DERWW.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaacaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaagggcccatcggtcttcccctc

SEQ ID NO: 452103 - DNA, 530 bp, Homo sapiens
  misc_feature: HEFZJCU01EKDEH.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgaggagggacggactacggtgactacgtgggggttccgaccccgtggggccaggggaaccctggtcaccgtctcctcagcctccaccg

SEQ ID NO: 452104 - DNA, 387 bp, Homo sapiens; identical to SEQ ID NO: 445170
  misc_feature: HEFZJCU01DHBXS.27.46.E02.1.454.heavy.3.raw

SEQ ID NO: 452105 - DNA, 309 bp, Homo sapiens
  misc_feature: HEFZJCU01CG6DL.18.53.E09.1.454.heavy.3.raw
tacgagtatgcacgaccggtgctcgatttagagagagtgtgttgggttgggtgcccaagctgctggagggcacggtcaccacgctgctgagcagcctgagatctgaggacacggccgtgtattactgtgctagagagggacgtatagtgggagctccctttgacttctggggccagggaaccctggtcaccgtctcctcagcttccaccaagggcccatcggtcttccccctggcgccctgctccaggagcacctctgggggcacagcggccctgggctgcctggtcaaggactacttccctactcgta

SEQ ID NO: 452106 - DNA, 533 bp, Homo sapiens
  misc_feature: HEFZJCU01B1VYN.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttatggggccagggancctggtcaccg

SEQ ID NO: 452107 - DNA, 532 bp, Homo sapiens
  misc_feature: HEFZJCU01DZJ46.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggtccagggaaccctggtcaccgtctcctcagcctccaccaaggg

SEQ ID NO: 452108 - DNA, 505 bp, Homo sapiens; identical to SEQ ID NO: 451855
  misc_feature: HEFZJCU01BBCH1.51.65.F10.1.454.heavy.3.raw

SEQ ID NO: 452109 - DNA, 531 bp, Homo sapiens; identical to SEQ ID NO: 445817
  misc_feature: HEFZJCU01CQ2RH.7.78.H01.1.454.heavy.3.raw

SEQ ID NO: 452110 - DNA, 488 bp, Homo sapiens
  misc_feature: HEFZJCU01ASESH.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcgtcttcccctggcgccctgctccaggagcacctccgagagcacagcggccctgggctgcctggtcaaggactacttcctacgtgagct

SEQ ID NO: 452111 - DNA, 395 bp, Homo sapiens; identical to SEQ ID NO: 444517
  misc_feature: HEFZJCU01A8CO9.16.68.G02.1.454.heavy.3.raw

SEQ ID NO: 452112 - DNA, 514 bp, Homo sapiens; identical to SEQ ID NO: 451530
  misc_feature: HEFZJCU01DSGVR.13.76.G10.1.454.heavy.3.raw

SEQ ID NO: 452113 - DNA, 481 bp, Homo sapiens; identical to SEQ ID NO: 445006
  misc_feature: HEFZJCU01CJ8EE.7.10.A10.1.454.heavy.3.raw

SEQ ID NO: 452114 - DNA, 450 bp, Homo sapiens
  misc_feature: HEFZJCU01EVLR0.16.53.E09.1.454.heavy.3.raw
tgtactactccacgaccggtgctcgatttagagagagtgtgttgggtttaggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 452115 - DNA, 526 bp, Homo sapiens; identical to SEQ ID NO: 445530
  misc_feature: HEFZJCU01C4MMR.12.86.H09.1.454.heavy.3.raw

SEQ ID NO: 452116 - DNA, 518 bp, Homo sapiens
  misc_feature: HEFZJCU01A8I0E.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaacccgtggtcaccgtctcctcagcctccaccaagggcccatcggtcttcccctggcaccctcctccaagagcacctctgggggcacagcggccctgggctgcctggtcaaggactacttaccg

SEQ ID NO: 452117 - DNA, 510 bp, Homo sapiens
  misc_feature: HEFZJCU01DKS10.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtgggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcacgtctctcctc

SEQ ID NO: 452118 - DNA, 372 bp, Homo sapiens; identical to SEQ ID NO: 444513
  misc_feature: HEFZJCU01EGV3G.5.23.C01.1.454.heavy.3.raw

SEQ ID NO: 452119 - DNA, 522 bp, Homo sapiens
  misc_feature: HEFZJCU01D4TNK.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccgccaagctccaggcaaggggattggagtgggtggcagttgtttcatctgagggcagtgttcaatgggtatgcagactccgtgaagggccgattcaccatctccagagacaattccaggaacacaatgtatttggaaatgaacagcctaagtcctgaggacacgggtgtagtactactgtacgaaggaggggggaaccaggacgggagttccaagtacttccg

SEQ ID NO: 452120 - DNA, 520 bp, Homo sapiens; identical to SEQ ID NO: 446666
  misc_feature: HEFZJCU01DFQM7.7.78.H01.1.454.heavy.3.raw

SEQ ID NO: 452121 - DNA, 516 bp, Homo sapiens
  misc_feature: HEFZJCU01B32KX.49.77.G11.1.454.heavy.3.raw
agtcgagagacacgaccggtgctcgatttagctagtcactcaagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctca

SEQ ID NO: 452122 - DNA, 512 bp, Homo sapiens
  misc_feature: HEFZJCU01AW53Z.53.12.B01.1.454.heavy.3.raw
cgcgtatacacacgaccggtgctcgatttagtagtgtagattccggggctgaactgaagaagcctggggcctcagtgaaggtttcctgcaaggcatctggatacaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaaggcccatcggtcttcccctggcaccctcctccaagagcacctctgggggcacagcggccctgggctgcctggtcaaggactacttcctcgtactgcg

SEQ ID NO: 452123 - DNA, 529 bp, Homo sapiens
  misc_feature: HEFZJCU01D89TD.17.26.C04.1.454.heavy.3.raw
cgtagactagcacgaccggtgctcgatttagtctagcgactttgggtttggggaagtagtcctgtcccagctgcagctgcaggagtcgggcccaggactggtgaagccttcggagaccctgtccctcacctgcactgtcactggtgactccatcagcagtagtagttactactggggctgcatccgccagcccccagggaaggggctggagcggattgggagtatccattatagtgggagcacccactacaacccgtccctcaagagtcgaatcaccatgtccgtagacacgtccaagaaccggttctccctgaaactgagctctgtgaccgccgcagacacggctgtgtattactgcatagcaatagcacagtacggaatggacgtctggggccaagggaccacggtcaccgtctccctggcctccaccaagggcccatcggtcttcccctggcaccctcctccaagagcacctctggggcacagcggccctgggctgcctggtcaaggactacttccctagtctacg

SEQ ID NO: 452124 - DNA, 509 bp, Homo sapiens
  misc_feature: HEFZJCU01EMKQT.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtctcccctgcgccctgctcaggagcacctctggggcacagcgcccg

SEQ ID NO: 452125 - DNA, 512 bp, Homo sapiens
  misc_feature: HEFZJCU01CMYNW.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgttaggctatttaaaagtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatgtagtggtagtacatactccgcagactccgtgaggggccattcaccatctccagagacaattccaagaacacgctgtttcttcaaatgaacagcctgagagccgatgacacggccgtgtattactgtgcgagagatggggcccacgaacgtttacacgctatggacgtcgtggggccg

SEQ ID NO: 452126 - DNA, 488 bp, Homo sapiens
  misc_feature: HEFZJCU01DS515.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggcctgggctgcctggtcaaggactacttcccatactcgta

SEQ ID NO: 452127 - DNA, 491 bp, Homo sapiens
  misc_feature: HEFZJCU01BLCOT.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccaggagcacctctgggggcacgagcggccctgggctgcctggtcaaggactacttcctatgtatact

SEQ ID NO: 452128 - DNA, 482 bp, Homo sapiens; identical to SEQ ID NO: 444904
  misc_feature: HEFZJCU01BB4Y1.47.59.F04.1.454.heavy.3.raw

SEQ ID NO: 452129 - DNA, 511 bp, Homo sapiens; identical to SEQ ID NO: 447235
  misc_feature: HEFZJCU01CB5ZD.16.21.B10.1.454.heavy.3.raw

SEQ ID NO: 452130 - DNA, 464 bp, Homo sapiens; identical to SEQ ID NO: 444693
  misc_feature: HEFZJCU01A2ENY.9.30.C08.1.454.heavy.3.raw

SEQ ID NO: 452131 - DNA, 487 bp, Homo sapiens
  misc_feature: HEFZJCU01A86RA.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggaggtcctcgttcttagggtcggcagtacgagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgcatctgacgacacggccgtatatttctgtgcgaggg

SEQ ID NO: 452132 - DNA, 483 bp, Homo sapiens; identical to SEQ ID NO: 444639
  misc_feature: HEFZJCU01DB6S9.11.23.C01.1.454.heavy.3.raw

SEQ ID NO: 452133 - DNA, 423 bp, Homo sapiens; identical to SEQ ID NO: 446550
  misc_feature: HEFZJCU01C1D0I.11.22.B11.1.454.heavy.3.raw

SEQ ID NO: 452134 - DNA, 498 bp, Homo sapiens
  misc_feature: HEFZJCU01AGFV9.40.7.A07.1.454.heavy.3.raw
tctagcgactcacgaccggtgctcgatttagcacgtgtcgcaggggacccaacaaccacatccctcctcagaagcccccagagcacaactccttaccatggactggacctggaggatcctctttttggtggcagcagccacaggtgtccactcccaggtccagcttgtgcagtctggggctgaggtgaagaagcctggggcctcagtgaaggtttcctgcacggcttctggatacaccttcactagatatgctatacattgggtgcgccaggcccccggacaaagacttgagtggatgggatggatccaccctggcaattataacacaaaacattcacagaagttccagggcagagtcaccattaccagggacacatccgcgagcacagtctacatggagctgagcagcctgagatctgaagacacggctgtgtattactgtgcgacgaatagtggctggcgagaggtgggatactactttgactttcgtggggccac

SEQ ID NO: 452135 - DNA, 523 bp, Homo sapiens
  misc_feature: HEFZJCU01CNNWZ.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttgggccagggaaccctggtcaccgtctcctcagcctccaccaacgggcccatcggtcttccccctcggccaccctcctccaagagcacctctcgggggcacagcggcc

SEQ ID NO: 452136 - DNA, 511 bp, Homo sapiens; identical to SEQ ID NO: 445840
  misc_feature: HEFZJCU01CXN6H.11.13.B02.1.454.heavy.3.raw

SEQ ID NO: 452137 - DNA, 496 bp, Homo sapiens; identical to SEQ ID NO: 446592
  misc_feature: HEFZJCU01B1H7N.4.75.G09.1.454.heavy.3.raw

SEQ ID NO: 452138 - DNA, 500 bp, Homo sapiens; identical to SEQ ID NO: 445080
  misc_feature: HEFZJCU01EHRZ3.3.81.H04.1.454.heavy.3.raw

SEQ ID NO: 452139 - DNA, 501 bp, Homo sapiens
  misc_feature: HEFZJCU01CVIRQ.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaacactggtcaccgtctcctcagcctccaccaagggcccatcggtcttcccctggcgccctgctccacggagcacctccgagagcacagcggccctgggctgcctggtcaaggactactccgac

SEQ ID NO: 452140 - DNA, 513 bp, Homo sapiens
  misc_feature: HEFZJCU01D4WWW.49.23.C01.1.454.heavy.3.raw
agtcgagagacacgaccggtgctcgatttagtacacgtgattagggattggggatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctc

SEQ ID NO: 452141 - DNA, 394 bp, Homo sapiens; identical to SEQ ID NO: 446347
  misc_feature: HEFZJCU01CDM1V.52.41.D08.1.454.heavy.3.raw

SEQ ID NO: 452142 - DNA, 470 bp, Homo sapiens
  misc_feature: HEFZJCU01DC094.11.79.H02.1.454.heavy.3.raw
cgagagataccacgaccggtgctcgatttagtgtcacacgaagggaaagggtccctgagactctcctgtgcagcctctggattcacttttagcaactatgtcatgcactgggtccgccaggctcctggaaaggggctggagtgggtctcgtctattgctggcaatgataataccgtaaactacgcagactccgtgaagggccggttcaccatctccagggacaattccatgaacacactttatcttcaattgaacaccctgagggccgacgacacggccgtatattactgtgcgaaggactacgatctcgagtacttctttgaccactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 452143 - DNA, 386 bp, Homo sapiens; identical to SEQ ID NO: 446054
  misc_feature: HEFZJCU01EL82V.18.60.F05.1.454.heavy.3.raw

SEQ ID NO: 452144 - DNA, 532 bp, Homo sapiens
  misc_feature: HEFZJCU01BLO62.51.49.E05.1.454.heavy.3.raw
cgatcgtatacacgaccggtgctcgatttagagcgactagcaacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagcccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcaggggaccacggtcgccgtctcttcagcctccaccaaggg

SEQ ID NO: 452145 - DNA, 516 bp, Homo sapiens
  misc_feature: HEFZJCU01DMD98.49.78.H01.1.454.heavy.3.raw
agtcgagagacacgaccggtgctcgatttagtgtgagtagtttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggcaccctcctccaagagcacctctgggggcacagcggccctgggctgcctggtcagactacttcctctctcgact

SEQ ID NO: 452146 - DNA, 516 bp, Homo sapiens
  misc_feature: HEFZJCU01ECTGK.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccagagcacctctgggggcacagcggcctgggctgcctggtcaaggactactcctagagacacg

SEQ ID NO: 452147 - DNA, 396 bp, Homo sapiens; identical to SEQ ID NO: 444469
  misc_feature: HEFZJCU01COY0Z.47.46.E02.1.454.heavy.3.raw

SEQ ID NO: 452148 - DNA, 521 bp, Homo sapiens; identical to SEQ ID NO: 448417
  misc_feature: HEFZJCU01A7Q4R.13.33.C11.1.454.heavy.3.raw

SEQ ID NO: 452149 - DNA, 532 bp, Homo sapiens
  misc_feature: HEFZJCU01AXWY1.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctgggg

SEQ ID NO: 452150 - DNA, 371 bp, Homo sapiens; identical to SEQ ID NO: 444435
  misc_feature: HEFZJCU01C8Q43.3.42.D09.1.454.heavy.3.raw

SEQ ID NO: 452151 - DNA, 510 bp, Homo sapiens
  misc_feature: HEFZJCU01C3PM8.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaagggctggagtgggtggccaacataaacaaagacggaagtcagaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 452152 - DNA, 524 bp, Homo sapiens
  misc_feature: HEFZJCU01CTBYL.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgttgacttttggggccagggaaccctggtcaccgtctcctcagcctccaccaagggcccatcggtcttcccctggcacctcctccaagagcacctctggggcacagcggccctggctg

SEQ ID NO: 452153 - DNA, 536 bp, Homo sapiens
  misc_feature: HEFZJCU01DGWOD.48.43.D10.1.454.heavy.3.raw
agtatacatacacgaccggtgctcgatttagactagcagtaagggggtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagttgacacgtccaagaaccagttctcccttcaactcacgtctgtgaccgccgcggacacggctatatactactgtgcgagagggtccctggctctctccgcctttgacgcctggggccgagggaaactggtcaccgtctcctcagcttccaccaacgggcccatcggtcttcccctggccgccctg

SEQ ID NO: 452154 - DNA, 490 bp, Homo sapiens; identical to SEQ ID NO: 446494
  misc_feature: HEFZJCU01BPQK1.11.13.B02.1.454.heavy.3.raw

SEQ ID NO: 452155 - DNA, 497 bp, Homo sapiens
  misc_feature: HEFZJCU01CXJVR.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaaggcccatcgtcttccctgcgcctgctcagagcacctctggggcacagcggccctggctgcctgtcaggactactcccat

SEQ ID NO: 452156 - DNA, 467 bp, Homo sapiens
  misc_feature: HEFZJCU01C3V3T.4.10.A10.1.454.heavy.3.raw
agcactgtagcacgaccggtgctcgatttagcgtcgatctcaggggtccctgagactctcctgtgcagcctctggattcaccttcacctcgtatagcatgacctgggtccgccaggctccagggaaggggctggagtgggtctcatccattggtactggtagtccttacatatactacttagactcagtgaggggccgattctccatctccagagacgactccaagaactcagtgtatctgcacatggacagcctgagagccgaggacacggctgtgtatttctgtgggaggtctccggtggtgctgagaaacggcgttgacttctggggccagggaaccctggtcaccgtctcctcagcctccaccaagggcccatcggtcttccccctggcgccctgctccaggagcacctccgagagcacagcggccctgggctgcctggtcaaggactacttccctaagtgct

SEQ ID NO: 452157 - DNA, 490 bp, Homo sapiens
  misc_feature: HEFZJCU01B6PYC.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaggactacttccgagtgcgtct

SEQ ID NO: 452158 - DNA, 501 bp, Homo sapiens
  misc_feature: HEFZJCU01ANTJ3.14.55.E11.1.454.heavy.3.raw
cgtctagtaccacgaccggtgctcgatttagcactcgcacgttgggtttggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgac

SEQ ID NO: 452159 - DNA, 375 bp, Homo sapiens; identical to SEQ ID NO: 444459
  misc_feature: HEFZJCU01DM631.48.59.F04.1.454.heavy.3.raw

SEQ ID NO: 452160 - DNA, 514 bp, Homo sapiens
  misc_feature: HEFZJCU01EEZHH.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttgggtttcgtcgtagtgctggtttgtagaactaggggccgagggaacgtacgtggtctaccgtcctccgtccagcctccaccg

SEQ ID NO: 452161 - DNA, 514 bp, Homo sapiens
  misc_feature: HEFZJCU01ANKFK.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtacaaagatggtcgttgtttgttttggccggtgaactactggggccagggcaccctggtcaccgtctcctcagcttccaccaagggcccatcggtcttcccctggcgccctgctccaggagcacctctgggggcacagcggccctgggctgcctggtcaggactacttcccatactcg

SEQ ID NO: 452162 - DNA, 495 bp, Homo sapiens; identical to SEQ ID NO: 451258
  misc_feature: HEFZJCU01EK3EX.12.2.A02.1.454.heavy.3.raw

SEQ ID NO: 452163 - DNA, 499 bp, Homo sapiens
  misc_feature: HEFZJCU01DXD4A.12.55.E11.1.454.heavy.3.raw
  modified_base (478)..(478): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctgcgccngctccagagcacctctggggc

SEQ ID NO: 452164 - DNA, 519 bp, Homo sapiens; identical to SEQ ID NO: 446650
  misc_feature: HEFZJCU01DLCV8.13.76.G10.1.454.heavy.3.raw

SEQ ID NO: 452165 - DNA, 512 bp, Homo sapiens
  misc_feature: HEFZJCU01DZXWT.49.35.D02.1.454.heavy.3.raw
agtcgagagacacgaccggtgctcgatttagcacacgatagttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttcccctggcaccctcctccaagagcacctctgggggcacagcggccctgggctgcctggtcaaggactacttcctctctcgact

SEQ ID NO: 452166 - DNA, 495 bp, Homo sapiens
  misc_feature: HEFZJCU01DRXUD.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtctcccctggcgccctgctccaggagcacctccgagagcacagcggccctgggctgcctggtcaaggactac

SEQ ID NO: 452167 - DNA, 522 bp, Homo sapiens; identical to SEQ ID NO: 445345
  misc_feature: HEFZJCU01B5MUO.19.86.H09.1.454.heavy.3.raw

SEQ ID NO: 452168 - DNA, 505 bp, Homo sapiens
  misc_feature: HEFZJCU01BR2OZ.48.29.C07.1.454.heavy.3.raw
agtatacatacacgaccggtgctcgatttagagtgctacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 452169 - DNA, 499 bp, Homo sapiens
  misc_feature: HEFZJCU01EFGVJ.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtctcccctgcgccctgctcc

SEQ ID NO: 452170 - DNA, 413 bp, Homo sapiens; identical to SEQ ID NO: 444933
  misc_feature: HEFZJCU01B2ULL.51.60.F05.1.454.heavy.3.raw

SEQ ID NO: 452171 - DNA, 503 bp, Homo sapiens
  misc_feature: HEFZJCU01EDM20.8.37.D04.1.454.heavy.3.raw
ctcgcgtgtccacgaccggtgctcgatttagtagcatactgttgggtttggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttcccctggcaccctcctccaagagcacctctgggggcacagcggccctgggctgcctggtcaaggactacttccgacacgcgag

SEQ ID NO: 452172 - DNA, 517 bp, Homo sapiens
  misc_feature: HEFZJCU01BOIAG.19.26.C04.1.454.heavy.3.raw
tactctcgtgcacgaccggtgctcgatttagtctagcgactttgggtttgggctgagcgtgggttttcctcgttagctcttttaagaggtgtccagtgtcaggtgcacctggtggagtctgggggaggcgtggtccagcctgggaggtccctgagactctcctgtgcagcctctggattcaccttcagtagctttggcatccacgtgggtccgccaggctccaggcgaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtcgtggggccaagggaccacggtcatcgtctcccagcctccaccaagggcccatcggtccttcccctggccgccctgctccaggacgc

SEQ ID NO: 452173 - DNA, 497 bp, Homo sapiens
  misc_feature: HEFZJCU01BZYUL.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaacgggcccatcggtccttccccctggccgccctgctccaggagcacctcgtgggggcacgagcggcccgtgggctgcctggtcaaggactacttcctatgtatact

SEQ ID NO: 452174 - DNA, 503 bp, Homo sapiens; identical to SEQ ID NO: 450415
  misc_feature: HEFZJCU01CU707.15.55.E11.1.454.heavy.3.raw

SEQ ID NO: 452175 - DNA, 506 bp, Homo sapiens
  misc_feature: HEFZJCU01C791C.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagtggttattatacctttgacttcg

SEQ ID NO: 452176 - DNA, 518 bp, Homo sapiens; identical to SEQ ID NO: 444718
  misc_feature: HEFZJCU01EVCYM.9.34.D01.1.454.heavy.3.raw

SEQ ID NO: 452177 - DNA, 504 bp, Homo sapiens
  misc_feature: HEFZJCU01E2D4A.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctcggcgccctgctccaggagcacctccgagagcacagcggccctgggctgcctggtcaaggactacttcccgacgcgacga

SEQ ID NO: 452178 - DNA, 391 bp, Homo sapiens; identical to SEQ ID NO: 446378
  misc_feature: HEFZJCU01ASOXD.16.24.C02.1.454.heavy.3.raw

SEQ ID NO: 452179 - DNA, 395 bp, Homo sapiens
  misc_feature: HEFZJCU01AK4OB.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcacccccctccaagagcacctctgggggcacagcggccctgggctgcctggtcaaggactacttccgagtagtaca

SEQ ID NO: 452180 - DNA, 492 bp, Homo sapiens; identical to SEQ ID NO: 444695
  misc_feature: HEFZJCU01EZXZQ.3.34.D01.1.454.heavy.3.raw

SEQ ID NO: 452181 - DNA, 512 bp, Homo sapiens; identical to SEQ ID NO: 446424
  misc_feature: HEFZJCU01DAS7Q.4.39.D06.1.454.heavy.3.raw

SEQ ID NO: 452182 - DNA, 506 bp, Homo sapiens
  misc_feature: HEFZJCU01CNNUJ.17.31.C09.1.454.heavy.3.raw
cgtagactagcacgaccggtgctcgatttagacgtctcatcaaggaaggaagggctgtagttgatgtgagagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttcccctcggcaccctcctccaagagcacctctgggggcacagcggccctgggctgcctggtcaaggactacttccctagtctacg

SEQ ID NO: 452183 - DNA, 503 bp, Homo sapiens
  misc_feature: HEFZJCU01BS36P.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttcggtttcgtcagtgctggttgtagaacgtgggccgaggactctcggtcaccgtctcctcacgcctccaccg

SEQ ID NO: 452184 - DNA, 486 bp, Homo sapiens
  misc_feature: HEFZJCU01DRH1A.49.4.A04.1.454.heavy.3.raw
agtcgagagacacgaccggtgctcgatttagagtagtgatcagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatattactgtgcgaacttaatcacgga

SEQ ID NO: 452185 - DNA, 492 bp, Homo sapiens; identical to SEQ ID NO: 444695
  misc_feature: HEFZJCU01D9SVW.3.34.D01.1.454.heavy.3.raw

SEQ ID NO: 452186 - DNA, 481 bp, Homo sapiens
  misc_feature: HEFZJCU01CZXDI.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaggactacttcctagagacacg

SEQ ID NO: 452187 - DNA, 501 bp, Homo sapiens; identical to SEQ ID NO: 445341
  misc_feature: HEFZJCU01A6GJW.48.34.D01.1.454.heavy.3.raw

SEQ ID NO: 452188 - DNA, 524 bp, Homo sapiens
  misc_feature: HEFZJCU01CCI3W.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccagggaagggcctggagtgggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacctggtcaccgtctcccaccctccaccaagggccatcggtcttcccctggcgccctgctccaggagcacctccgagagcacagcggccctgggctgcctggtcaaggactacttcccatactcgta

SEQ ID NO: 452189 - DNA, 519 bp, Homo sapiens; identical to SEQ ID NO: 446487
  misc_feature: HEFZJCU01A41U7.7.78.H01.1.454.heavy.3.raw

SEQ ID NO: 452190 - DNA, 510 bp, Homo sapiens
  misc_feature: HEFZJCU01EQ6R6.48.25.C03.1.454.heavy.3.raw
agtatacatacacgaccggtgctcgatttagtagtgtagatttgggtttgggggagccttggtgcagcctggagagtccctaagactctcctgcgcagcctcaggattcagtttcagtagttatgaaatgaattgggtccgccaggctccagggaagggactggagtggcttttcatatattactggcagtgggtctcttacccattatgcagactctgtgaggggccgattcaccatctccagagacaacccccgaaactctctttttctgcaaatggacagcctgacagccgacgatacggccatttattactgtgcgagagatgggaccccgcatatccagaaggcacactctactttgacctctggggccaggggatcctggtcaccgtctcctcagcctccaccaagggcccatcggtcttcccctggcgccctgctccaggagcacctcccgagagcacagcggccctgggctgcctggtcaaggactacttcctatgtatact

SEQ ID NO: 452191 - DNA, 525 bp, Homo sapiens
  misc_feature: HEFZJCU01AUL6O.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtgggggcccacggaaccgttactacgctatggacgtctgggggccaaggggacccg

SEQ ID NO: 452192 - DNA, 489 bp, Homo sapiens
  misc_feature: HEFZJCU01CN8Y6.49.38.D05.1.454.heavy.3.raw
agtcgagagacacgaccggtgctcgatttagtatctgatagttgggtttgggggacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacg

SEQ ID NO: 452193 - DNA, 500 bp, Homo sapiens
  misc_feature: HEFZJCU01EROKW.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtt

SEQ ID NO: 452194 - DNA, 531 bp, Homo sapiens
  misc_feature: HEFZJCU01DDCJW.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgtttattggggccagggagccctggtcaccg

SEQ ID NO: 452195 - DNA, 503 bp, Homo sapiens
  misc_feature: HEFZJCU01D9T8R.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactgggccagggaaccctggtcaccgtctcttcagcctccaccaaggcccatcggtcttcccctgcaccctcctccaagagcacctctgggggcacagcggccctgggctgcctggtcaaggactacttccgtactagacg

SEQ ID NO: 452196 - DNA, 395 bp, Homo sapiens
  misc_feature: HEFZJCU01AMCLM.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 452197 - DNA, 323 bp, Homo sapiens; identical to SEQ ID NO: 444416
  misc_feature: HEFZJCU01CLE80.47.38.D05.1.454.heavy.3.raw

SEQ ID NO: 452198 - DNA, 504 bp, Homo sapiens
  misc_feature: HEFZJCU01BVJGX.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtttggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccg

SEQ ID NO: 452199 - DNA, 494 bp, Homo sapiens
  misc_feature: HEFZJCU01EJ7BL.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggtttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 452200 - DNA, 511 bp, Homo sapiens
  misc_feature: HEFZJCU01D4XN8.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggaccg

SEQ ID NO: 452201 - DNA, 521 bp, Homo sapiens
  misc_feature: HEFZJCU01CSJZ9.9.63.F08.1.454.heavy.3.raw
  modified_base (512)..(512): a, c, t, g, unknown or other
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctccgnggacgcacg

SEQ ID NO: 452202 - DNA, 533 bp, Homo sapiens
  misc_feature: HEFZJCU01BVQFP.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaacccgtggtcaccgtctcctcagcctccaccaaggccatcggtcttcccctc

SEQ ID NO: 452203 - DNA, 512 bp, Homo sapiens
  misc_feature: HEFZJCU01BABHQ.52.78.H01.1.454.heavy.3.raw
cgcagtacgacacgaccggtgctcgatttagtgtgagtagtttgggtttgggaccggtgctcgattcagtgtgaggcgcagctggtggagtctggggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtgacaccctggtcactgtcttctcagcctccaccaagggcccatcggtcttcccctggcaccctcctccaagagcacctcg

SEQ ID NO: 452204 - DNA, 524 bp, Homo sapiens
  misc_feature: HEFZJCU01A29MT.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggtctacttcgatctctggggccgtc

SEQ ID NO: 452205 - DNA, 399 bp, Homo sapiens
  misc_feature: HEFZJCU01D5I3W.53.46.E02.1.454.heavy.3.raw
cgcgtatacacacgaccggtgctcgatttagactcatctacagggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 452206 - DNA, 453 bp, Homo sapiens
  misc_feature: HEFZJCU01EK6XH.51.82.H05.1.454.heavy.3.raw
cgatcgtatacacgaccggtgctcgatttagtcgagctctctcgcgggcacgaccggtgctcgatttagtcacgcgagaaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 452207 - DNA, 488 bp, Homo sapiens
  misc_feature: HEFZJCU01C02KO.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctggctgcctggtcaaggactacttcctacgtgagct

SEQ ID NO: 452208 - DNA, 533 bp, Homo sapiens
  misc_feature: HEFZJCU01BON3D.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 452209 - DNA, 400 bp, Homo sapiens; identical to SEQ ID NO: 444452
  misc_feature: HEFZJCU01BX6RU.47.24.C02.1.454.heavy.3.raw

SEQ ID NO: 452210 - DNA, 532 bp, Homo sapiens
  misc_feature: HEFZJCU01DWT9S.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacgggtgactactgggggttcgaccccgtgggggcccaggggaaccctgggtcaccgtctcctcagcctccaccg

SEQ ID NO: 452211 - DNA, 526 bp, Homo sapiens
  misc_feature: HEFZJCU01CGFC4.16.87.H10.1.454.heavy.3.raw
  modified_base (463)..(463): a, c, t, g, unknown or other
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtncaaggcagttcgtggaaacagttatggttggggggagttgggttttttttcgttacttacggg

SEQ ID NO: 452212 - DNA, 531 bp, Homo sapiens; identical to SEQ ID NO: 446857
  misc_feature: HEFZJCU01A7OED.7.78.H01.1.454.heavy.3.raw

SEQ ID NO: 452213 - DNA, 499 bp, Homo sapiens
  misc_feature: HEFZJCU01A82P4.52.6.A06.1.454.heavy.3.raw
cgcagtacgacacgaccggtgctcgatttagatctactgacagggggggagacgagcccagcactggaagtcgccggtgtttccattcggtgatcatcactgaacacagaggactcaccatggagtttgggcagagctgggttctcctcgttgttcttttaagaggtgtccagtgtcaggctccaggcaagggactggagtgggtggcagttatatcagctgatggaggcaataagtattacgcagattctgcgaggggccgattcaccatatccagagacaactcccaagatatgatatatctgcaaatgaacagcctgagacctgaggacacggccatatattattgtgcgtcagggggcagtgcctggccacgtgatgcttttgatttctggggccaagggacattcgtcaccgtctcctcagcctccaccaagggcccatcggtcttcccctggcaccctcctccaagagcacctctgggggcacagcggccctc

SEQ ID NO: 452214 - DNA, 479 bp, Homo sapiens
  misc_feature: HEFZJCU01B7T7A.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccacgcgtatgt

SEQ ID NO: 452215 - DNA, 424 bp, Homo sapiens
  misc_feature: HEFZJCU01B002B.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacggccagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 452216 - DNA, 500 bp, Homo sapiens; identical to SEQ ID NO: 444529
  misc_feature: HEFZJCU01ASA88.12.38.D05.1.454.heavy.3.raw

SEQ ID NO: 452217 - DNA, 396 bp, Homo sapiens; identical to SEQ ID NO: 445380
  misc_feature: HEFZJCU01DOE33.12.72.G06.1.454.heavy.3.raw

SEQ ID NO: 452218 - DNA, 525 bp, Homo sapiens
  misc_feature: HEFZJCU01B7023.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctcccagcctccaccaaggcccatcggtcttcccctggcgcctcg

SEQ ID NO: 452219 - DNA, 520 bp, Homo sapiens
  misc_feature: HEFZJCU01D318Y.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttatttacc

SEQ ID NO: 452220 - DNA, 513 bp, Homo sapiens
  misc_feature: HEFZJCU01ETEO4.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttacgtcacccatactactttgactacgtgggccaac

SEQ ID NO: 452221 - DNA, 509 bp, Homo sapiens
  misc_feature: HEFZJCU01AL54U.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttcccctggcaccctcctccaagagcacctctgggggcacagcggccctgggctgcctggtcaaggacta

SEQ ID NO: 452222 - DNA, 508 bp, Homo sapiens; identical to SEQ ID NO: 445288
  misc_feature: HEFZJCU01CPI5U.51.43.D10.1.454.heavy.3.raw

SEQ ID NO: 452223 - DNA, 520 bp, Homo sapiens
  misc_feature: HEFZJCU01C3S0S.11.12.B01.1.454.heavy.3.raw
cgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaatgaacagcctgagagccgatgacacggccgtgtattactgtgcgagagatggggcccacgaacgttactacgctatggacgtctggggccaagggacc

SEQ ID NO: 452224 - DNA, 519 bp, Homo sapiens; identical to SEQ ID NO: 444867
  misc_feature: HEFZJCU01EG4GI.9.34.D01.1.454.heavy.3.raw

SEQ ID NO: 452225 - DNA, 488 bp, Homo sapiens; identical to SEQ ID NO: 444617
  misc_feature: HEFZJCU01BQUI0.4.6.A06.1.454.heavy.3.raw

SEQ ID NO: 452226 - DNA, 509 bp, Homo sapiens; identical to SEQ ID NO: 445824
  misc_feature: HEFZJCU01CFKTU.9.14.B03.1.454.heavy.3.raw

SEQ ID NO: 452227 - DNA, 531 bp, Homo sapiens; identical to SEQ ID NO: 446857
  misc_feature: HEFZJCU01D1SI8.7.78.H01.1.454.heavy.3.raw

SEQ ID NO: 452228 - DNA, 506 bp, Homo sapiens; identical to SEQ ID NO: 444696
  misc_feature: HEFZJCU01C2H5S.16.34.D01.1.454.heavy.3.raw

SEQ ID NO: 452229 - DNA, 510 bp, Homo sapiens
  misc_feature: HEFZJCU01CU0LN.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcacagcggccctggg

SEQ ID NO: 452230 - DNA, 371 bp, Homo sapiens; identical to SEQ ID NO: 444435
  misc_feature: HEFZJCU01BHIIA.3.42.D09.1.454.heavy.3.raw

SEQ ID NO: 452231 - DNA, 521 bp, Homo sapiens
  misc_feature: HEFZJCU01CXBRT.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccccgtggtcaccgtctccttcagcttccaccaagggcccatcggtcttcccctggcgccctcgctccaggagcacctctgggggcacagccggcccgg

SEQ ID NO: 452232 - DNA, 508 bp, Homo sapiens
  misc_feature: HEFZJCU01DXMVF.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgaggagtcccacgatccggtgagcctacggcagcggcctttgacttcgtggggcccaggg

SEQ ID NO: 452233 - DNA, 520 bp, Homo sapiens
  misc_feature: HEFZJCU01ET7F7.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctattctgcaatgaacagcctgagagtcgacgacacggccgtatactactgtgcgagacagatgctgccgcctgttccgtggggccagggaaccctggtcaccgt

SEQ ID NO: 452234 - DNA, 480 bp, Homo sapiens; identical to SEQ ID NO: 446171
  misc_feature: HEFZJCU01D1H4B.22.36.D03.1.454.heavy.3.raw

SEQ ID NO: 452235 - DNA, 504 bp, Homo sapiens
  misc_feature: HEFZJCU01E0FKA.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaataggtacgtacg

SEQ ID NO: 452236 - DNA, 520 bp, Homo sapiens; identical to SEQ ID NO: 446666
  misc_feature: HEFZJCU01BG1IY.7.78.H01.1.454.heavy.3.raw

SEQ ID NO: 452237 - DNA, 511 bp, Homo sapiens
  misc_feature: HEFZJCU01A82ET.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaattgaagaacacgctgtttctgcaaatgaacagcctgagagctgaggacacggctgtgtattactgttcgtttggttctgactcgtcgggggaataccttcagcac

SEQ ID NO: 452238 - DNA, 509 bp, Homo sapiens
  misc_feature: HEFZJCU01EAGVC.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttgactactgggccac

SEQ ID NO: 452239 - DNA, 512 bp, Homo sapiens; identical to SEQ ID NO: 445688
  misc_feature: HEFZJCU01E0TPG.3.34.D01.1.454.heavy.3.raw

SEQ ID NO: 452240 - DNA, 495 bp, Homo sapiens
  misc_feature: HEFZJCU01C8212.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgtttattactgtgcgcgggatagaggctcatcgtggatacaa

SEQ ID NO: 452241 - DNA, 482 bp, Homo sapiens; identical to SEQ ID NO: 444503
  misc_feature: HEFZJCU01C8AY7.7.10.A10.1.454.heavy.3.raw

SEQ ID NO: 452242 - DNA, 511 bp, Homo sapiens; identical to SEQ ID NO: 445840
  misc_feature: HEFZJCU01CKPWV.11.13.B02.1.454.heavy.3.raw

SEQ ID NO: 452243 - DNA, 511 bp, Homo sapiens; identical to SEQ ID NO: 445840
  misc_feature: HEFZJCU01A3NFU.11.13.B02.1.454.heavy.3.raw

SEQ ID NO: 452244 - DNA, 520 bp, Homo sapiens
  misc_feature: HEFZJCU01ARJE1.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaaggcccatcggtcttcccctggcgccctgctccaggagcacctccgagagcacagccggccc

SEQ ID NO: 452245 - DNA, 477 bp, Homo sapiens; identical to SEQ ID NO: 444659
  misc_feature: HEFZJCU01DGF39.16.10.A10.1.454.heavy.3.raw

SEQ ID NO: 452246 - DNA, 501 bp, Homo sapiens; identical to SEQ ID NO: 447123
  misc_feature: HEFZJCU01AFJ0E.3.20.B09.1.454.heavy.3.raw

SEQ ID NO: 452247 - DNA, 452 bp, Homo sapiens
  misc_feature: HEFZJCU01A4F4K.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgtatatgtggggccaagggacaatggtcaccgtctcttcagcctccaccaagggcccatcggtcttccccctggcgccctgctccaggagcacctccgagagcacagcggccctgggcctgcctggtcaaggactacttccagacgtatca

SEQ ID NO: 452248 - DNA, 506 bp, Homo sapiens
  misc_feature: HEFZJCU01DSZBW.51.71.G05.1.454.heavy.3.raw
cgatcgtatacacgaccggtgctcgatttagtgtcgtcgcaagagagagggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctgggccaagggacaatggtcattgtctcttcagcctccaccaagggcccatcgtcttcccctggcaccctcctccaagagcacctctgggggcacgagcggccctgggctgcctggtcaaggactacttcccg

SEQ ID NO: 452249 - DNA, 514 bp, Homo sapiens; identical to SEQ ID NO: 445776
  misc_feature: HEFZJCU01C14PU.17.33.C11.1.454.heavy.3.raw

SEQ ID NO: 452250 - DNA, 542 bp, Homo sapiens
  misc_feature: HEFZJCU01B29SQ.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggccaggggaaccctggtcc

SEQ ID NO: 452251 - DNA, 521 bp, Homo sapiens
  misc_feature: HEFZJCU01AH4R1.51.58.F03.1.454.heavy.3.raw
cgatcgtatacacgaccggtgctcgatttagtctgatcgagaagggaaaggggggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactaccttgaaaactggggccacggaaccctggtcaccgtctcctcagcctccaccaagggcccatcggtcttcccctggcaccctcctcc

SEQ ID NO: 452252 - DNA, 483 bp, Homo sapiens; identical to SEQ ID NO: 444924
  misc_feature: HEFZJCU01AG4Z2.10.35.D02.1.454.heavy.3.raw

SEQ ID NO: 452253 - DNA, 527 bp, Homo sapiens
  misc_feature: HEFZJCU01BI0N1.18.39.D06.1.454.heavy.3.raw
  modified_base (448)..(448): a, c, t, g, unknown or other
  modified_base (455)..(455): a, c, t, g, unknown or other
  modified_base (459)..(459): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgcctcnctacagngacncctcggtcgggcgacgcgccgccggtcggcgtcgtcgtcgtacgaacgacgttacctacctactaccg

SEQ ID NO: 452254 - DNA, 519 bp, Homo sapiens
  misc_feature: HEFZJCU01C1VJ5.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctgggccagggaacccaggtcaccgtctcctcagcctccaccaagggcccatccgtcttccccctgcgccctgctccaggagcacctccgagagcacagcggccctgggctgcctggtcaaggattacttcctacg

SEQ ID NO: 452255 - DNA, 507 bp, Homo sapiens
  misc_feature: HEFZJCU01C0ZSO.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaattaacgaacacagttaatctggagctgaacagcctatcatctgaggacacgggcttctacttctgtgcgaggagtaattactataacactgctcttttacactccttgacttctgggc

SEQ ID NO: 452256 - DNA, 378 bp, Homo sapiens
  misc_feature: HEFZJCU01B99KD.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttccacgtgagct

SEQ ID NO: 452257 - DNA, 396 bp, Homo sapiens; identical to SEQ ID NO: 444469
  misc_feature: HEFZJCU01DV2X5.47.46.E02.1.454.heavy.3.raw

SEQ ID NO: 452258 - DNA, 384 bp, Homo sapiens; identical to SEQ ID NO: 444454
  misc_feature: HEFZJCU01EWB3Y.11.61.F06.1.454.heavy.3.raw

SEQ ID NO: 452259 - DNA, 383 bp, Homo sapiens; identical to SEQ ID NO: 444477
  misc_feature: HEFZJCU01CJHF9.47.60.F05.1.454.heavy.3.raw

SEQ ID NO: 452260 - DNA, 398 bp, Homo sapiens
  misc_feature: HEFZJCU01AUTYF.47.46.E02.1.454.heavy.3.raw
agctcacgtacacgaccggtgctcgatttagactcatctacaggggaaaggggctggagtgggtctcaagtattgatgagaatggtggaagcacattctacgtggactccgtgaagggccggttcaccatctccagagacaatttcaggtagcacgctgttatctacaaatgaacagcctgagagccgaggacacggccgtagtatttctgtgcgaaagtctatagcagtgccccctagcgcacttctttgacttctgggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 452261 - DNA, 484 bp, Homo sapiens; identical to SEQ ID NO: 445311
  misc_feature: HEFZJCU01CV9YK.11.23.C01.1.454.heavy.3.raw

SEQ ID NO: 452262 - DNA, 521 bp, Homo sapiens
  misc_feature: HEFZJCU01CDNE3.12.40.D07.1.454.heavy.3.raw
  modified_base (461)..(461): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccnggggaccctggtcatcgtctccccagcctccaccaagggcccatcggtcttcccctggcg

SEQ ID NO: 452263 - DNA, 536 bp, Homo sapiens
  misc_feature: HEFZJCU01EU80C.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtacaactactactactacggtatggacctcgtgggaccg

SEQ ID NO: 452264 - DNA, 518 bp, Homo sapiens; identical to SEQ ID NO: 444718
  misc_feature: HEFZJCU01AQ01D.9.34.D01.1.454.heavy.3.raw

SEQ ID NO: 452265 - DNA, 488 bp, Homo sapiens; identical to SEQ ID NO: 450325
  misc_feature: HEFZJCU01E1KTS.10.85.H08.1.454.heavy.3.raw

SEQ ID NO: 452266 - DNA, 489 bp, Homo sapiens; identical to SEQ ID NO: 444791
  misc_feature: HEFZJCU01CGADK.47.85.H08.1.454.heavy.3.raw

SEQ ID NO: 452267 - DNA, 522 bp, Homo sapiens
  misc_feature: HEFZJCU01DB8PW.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtcgtcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggagcacctccgagagcacagcggccctgggctgcctggtcaaggactacttcctacg

SEQ ID NO: 452268 - DNA, 517 bp, Homo sapiens
  misc_feature: HEFZJCU01CWEHT.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgtccggtcctgcacctcgtgtggccccaattttggtttaccggcacacaaaatcagggcaagtccttacgacggtctggacgttcg

SEQ ID NO: 452269 - DNA, 513 bp, Homo sapiens
  misc_feature: HEFZJCU01BUKEJ.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaaggggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 452270 - DNA, 507 bp, Homo sapiens
  misc_feature: HEFZJCU01CJN9P.53.37.D04.1.454.heavy.3.raw
cgcgtatacacacgaccggtgctcgatttagtagcatactgttgggtttgggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgat

SEQ ID NO: 452271 - DNA, 518 bp, Homo sapiens
  misc_feature: HEFZJCU01EMU90.49.34.D01.1.454.heavy.3.raw
agtcgagagacacgaccggtgctcgatttagatcgtctgtgttgggtttggggacccaacaaccacatccctcctcagaagccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaaccccggtcaccgtctcctctgcct

SEQ ID NO: 452272 - DNA, 385 bp, Homo sapiens; identical to SEQ ID NO: 448034
  misc_feature: HEFZJCU01EGER2.13.24.C02.1.454.heavy.3.raw

SEQ ID NO: 452273 - DNA, 450 bp, Homo sapiens; identical to SEQ ID NO: 447469
  misc_feature: HEFZJCU01CR6JC.52.5.A05.1.454.heavy.3.raw

SEQ ID NO: 452274 - DNA, 482 bp, Homo sapiens
  misc_feature: HEFZJCU01EYS2P.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaacgagcacctctgggggcacagcggccctgggctgcctggtcaaggactacttcctagagacacg

SEQ ID NO: 452275 - DNA, 510 bp, Homo sapiens
  misc_feature: HEFZJCU01CURWU.10.5.A05.1.454.heavy.3.raw
catagtagtgcacgaccggtgctcgatttagatagatagacagggggagtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatgcccggggaaggcctggagtggatggggatcatcaatcttggtagctctgaaaccagatacaccccgtccttccaaggccgggtcaccatctcagccgacaggtccatcagtactacctacttggagtggattagcctgaaggcctcggacaccgccatgtattactgtacgagacttgaacggggattctattatggcgcgatctggggccagggaaccctggtcacccg

SEQ ID NO: 452276 - DNA, 467 bp, Homo sapiens; identical to SEQ ID NO: 445159
  misc_feature: HEFZJCU01EV3SM.48.7.A07.1.454.heavy.3.raw

SEQ ID NO: 452277 - DNA, 480 bp, Homo sapiens; identical to SEQ ID NO: 445011
  misc_feature: HEFZJCU01DBE0B.22.36.D03.1.454.heavy.3.raw

SEQ ID NO: 452278 - DNA, 533 bp, Homo sapiens
  misc_feature: HEFZJCU01CA8OX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttccctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccagtccggtcttcccctcggtccgcctcg

SEQ ID NO: 452279 - DNA, 506 bp, Homo sapiens
  misc_feature: HEFZJCU01EI3TX.16.34.D01.1.454.heavy.3.raw
tgtactactccacgaccggtgctcgatttagatcgtctgtgttgggtttgggggaggcttggtacagccgtggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctggctgcctggtcaaggactacttccgagtagtaca

SEQ ID NO: 452280 - DNA, 396 bp, Homo sapiens; identical to SEQ ID NO: 444469
  misc_feature: HEFZJCU01DZPD6.47.46.E02.1.454.heavy.3.raw

SEQ ID NO: 452281 - DNA, 507 bp, Homo sapiens
  misc_feature: HEFZJCU01CMPPI.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 452282 - DNA, 396 bp, Homo sapiens; identical to SEQ ID NO: 444469
  misc_feature: HEFZJCU01DNDU4.47.46.E02.1.454.heavy.3.raw

SEQ ID NO: 452283 - DNA, 516 bp, Homo sapiens
  misc_feature: HEFZJCU01E08MK.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgacaacgtgaagcctgcggacacggccacatattattgtgcacaccgacgctataccgccagctgggaaatcgacaactggttcgacccctggggccagggaacccttgtcaccgtctcctcagcctccaccaaggccacg

SEQ ID NO: 452284 - DNA, 529 bp, Homo sapiens
  misc_feature: HEFZJCU01CQ2CD.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctgggccatggaaccccggtcaccgt

SEQ ID NO: 452285 - DNA, 378 bp, Homo sapiens
  misc_feature: HEFZJCU01ET61U.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccgtctcctcagcctccaccaagggcccatccgtcttccccctggcgccctgctccaggagcacctccgagagcacagcggccctgggctgcctggtcaaggactacttcctacgtcgtat

SEQ ID NO: 452286 - DNA, 513 bp, Homo sapiens
  misc_feature: HEFZJCU01D82KK.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccatggaactctggtcaccgtctccgcagcctccaccaagggccc

SEQ ID NO: 452287 - DNA, 523 bp, Homo sapiens
  misc_feature: HEFZJCU01DPQ0B.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccagagcacctccgagagcacagcggccctgggctgcctggtcaaggactacttcc

SEQ ID NO: 452288 - DNA, 532 bp, Homo sapiens
  misc_feature: HEFZJCU01D73ON.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcccccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgttattggggccagggagccctggtcacgt

SEQ ID NO: 452289 - DNA, 503 bp, Homo sapiens; identical to SEQ ID NO: 445995
  misc_feature: HEFZJCU01C3EBO.17.25.C03.1.454.heavy.3.raw

SEQ ID NO: 452290 - DNA, 504 bp, Homo sapiens; identical to SEQ ID NO: 447065
  misc_feature: HEFZJCU01CJ8DY.10.23.C01.1.454.heavy.3.raw

SEQ ID NO: 452291 - DNA, 515 bp, Homo sapiens
  misc_feature: HEFZJCU01C4QVH.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaaggcccatcggtcttcccctggcaccctcctccaagagcacctctgggggcacagcggcctgggctgcctggtcaaggactacttccagacgtatca

SEQ ID NO: 452292 - DNA, 383 bp, Homo sapiens; identical to SEQ ID NO: 444477
  misc_feature: HEFZJCU01A8RSU.47.60.F05.1.454.heavy.3.raw

SEQ ID NO: 452293 - DNA, 437 bp, Homo sapiens; identical to SEQ ID NO: 444603
  misc_feature: HEFZJCU01E2GGC.3.21.B10.1.454.heavy.3.raw

SEQ ID NO: 452294 - DNA, 505 bp, Homo sapiens
  misc_feature: HEFZJCU01BBY3H.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctcagagcacctctggggcacagcggcctgggctgctggtcaaggactacttcccata

SEQ ID NO: 452295 - DNA, 519 bp, Homo sapiens
  misc_feature: HEFZJCU01BXGO4.48.55.E11.1.454.heavy.3.raw
agtatacatacacgaccggtgctcgatttagcactcgcacgttgggtttgggatctacgttgcaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctcggcgccctcgctccaggacgcacctccgagaggcacacgcggcccgtgggctgccgtggtcaaggactacttcctta

SEQ ID NO: 452296 - DNA, 492 bp, Homo sapiens
  misc_feature: HEFZJCU01ED7RX.22.86.H09.1.454.heavy.3.raw
acatacgcgtcacgaccggtgctcgatttagtgctatagacttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgactacggg

SEQ ID NO: 452297 - DNA, 519 bp, Homo sapiens
  misc_feature: HEFZJCU01AYV7W.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctcggttcctttcgacagttatggtatggacgtctggggcctagggactacggtcaccgtctcctcagcctccaccaacgggcccatcggtcttccccctggccta

SEQ ID NO: 452298 - DNA, 492 bp, Homo sapiens
  misc_feature: HEFZJCU01AOLVJ.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 452299 - DNA, 477 bp, Homo sapiens; identical to SEQ ID NO: 444659
  misc_feature: HEFZJCU01EZ3BL.16.10.A10.1.454.heavy.3.raw

SEQ ID NO: 452300 - DNA, 511 bp, Homo sapiens
  misc_feature: HEFZJCU01ANMRG.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctgggagtggatctcagggattaggtggcactgggcgatttatacataattatacagactccgtgaagggccgcttcaccatctccagagacaattccaagaacacggtgtatctgcaaatgaacagcctgagagccgaggacacggccacatattactgtgcgaaagatctcgggctggtccgcggtccggg

SEQ ID NO: 452301 - DNA, 406 bp, Homo sapiens
  misc_feature: HEFZJCU01CSJHD.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttccgagtaggtaca

SEQ ID NO: 452302 - DNA, 533 bp, Homo sapiens
  misc_feature: HEFZJCU01AMBHH.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttactacctcccttcgtacttctggggccatggaaccccggtccg

SEQ ID NO: 452303 - DNA, 520 bp, Homo sapiens
  misc_feature: HEFZJCU01DLSNF.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgacgagcacagcggccc

SEQ ID NO: 452304 - DNA, 531 bp, Homo sapiens
  misc_feature: HEFZJCU01B9YRQ.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaaggcccatcggtcttcccctggcaccctcctccaagagcacctctgggggcacagcggccctgggctgcctc

SEQ ID NO: 452305 - DNA, 490 bp, Homo sapiens
  misc_feature: HEFZJCU01D7GHP.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggacctggtcaccgtctcctcggcctccaccaagggcccatcggtcttcccctggcgccctgctccaggagcacctccgagagcacagcggccctgggctgcctggtcaaggactacttccctacagtgct

SEQ ID NO: 452306 - DNA, 523 bp, Homo sapiens
  misc_feature: HEFZJCU01EB44J.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggccccatccgtcttccccctggcgccctgctccaggagcacctccgacgagcacagcggccctgggctgcctggtcaggactacttcctacg

SEQ ID NO: 452307 - DNA, 506 bp, Homo sapiens
  misc_feature: HEFZJCU01CIQHA.8.38.D05.1.454.heavy.3.raw
ctcgcgtgtccacgaccggtgctcgatttagtatctgatagttgggtttggggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactac

SEQ ID NO: 452308 - DNA, 488 bp, Homo sapiens
  misc_feature: HEFZJCU01DE14K.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcggacatgacg

SEQ ID NO: 452309 - DNA, 537 bp, Homo sapiens
  misc_feature: HEFZJCU01EZD6N.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccatcggtcttcccctggcaccctcctccaagagcacctctgggggcacagcggcctgggctgcctggtacg

SEQ ID NO: 452310 - DNA, 498 bp, Homo sapiens
  misc_feature: HEFZJCU01CULM4.52.78.H01.1.454.heavy.3.raw
cgcagtacgacacgaccggtgctcgatttagtgtgagtagtttgggtttgggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacgatcg

SEQ ID NO: 452311 - DNA, 489 bp, Homo sapiens
  misc_feature: HEFZJCU01BY1UB.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtctcccctggcgccctgctccaggagcacctccgagagcacagcggccctgggctgcctggtcaaggactacttcccacgagagta

SEQ ID NO: 452312 - DNA, 481 bp, Homo sapiens; identical to SEQ ID NO: 448054
  misc_feature: HEFZJCU01CX0K3.22.36.D03.1.454.heavy.3.raw

SEQ ID NO: 452313 - DNA, 507 bp, Homo sapiens
  misc_feature: HEFZJCU01CY1I8.11.67.G01.1.454.heavy.3.raw
cgagagataccacgaccggtgctcgatttagagtatacatattgggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctggggggcacagcggccctgggctgcctggtcaaggactac

SEQ ID NO: 452314 - DNA, 506 bp, Homo sapiens; identical to SEQ ID NO: 449588
  misc_feature: HEFZJCU01DM3AY.11.72.G06.1.454.heavy.3.raw

SEQ ID NO: 452315 - DNA, 405 bp, Homo sapiens; identical to SEQ ID NO: 447426
  misc_feature: HEFZJCU01BYHFJ.53.77.G11.1.454.heavy.3.raw

SEQ ID NO: 452316 - DNA, 490 bp, Homo sapiens; identical to SEQ ID NO: 444500
  misc_feature: HEFZJCU01BP3LD.19.53.E09.1.454.heavy.3.raw

SEQ ID NO: 452317 - DNA, 508 bp, Homo sapiens; identical to SEQ ID NO: 448191
  misc_feature: HEFZJCU01EHHHE.4.67.G01.1.454.heavy.3.raw

SEQ ID NO: 452318 - DNA, 516 bp, Homo sapiens
  misc_feature: HEFZJCU01EPDXV.13.36.D03.1.454.heavy.3.raw
tcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgaggacactgccatttattactgtgtgagagattctttccttgactacggtacttctgtccttgactactggggccagggtaacccg

SEQ ID NO: 452319 - DNA, 511 bp, Homo sapiens
  misc_feature: HEFZJCU01BW0ZG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagccctacgggcaaggcggcctttgacctttcgtc

SEQ ID NO: 452320 - DNA, 480 bp, Homo sapiens
  misc_feature: HEFZJCU01A5ZID.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggcctgggctgcctggtcaaggactacttcctagagacacg

SEQ ID NO: 452321 - DNA, 518 bp, Homo sapiens; identical to SEQ ID NO: 444718
  misc_feature: HEFZJCU01C2OIU.9.34.D01.1.454.heavy.3.raw

SEQ ID NO: 452322 - DNA, 490 bp, Homo sapiens
  misc_feature: HEFZJCU01BTYUZ.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactcccgtgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 452323 - DNA, 510 bp, Homo sapiens
  misc_feature: HEFZJCU01CZWWW.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggcgacggaaaccttgactactggggccagggaaccctggtcaccgt

SEQ ID NO: 452324 - DNA, 407 bp, Homo sapiens
  misc_feature: HEFZJCU01ENFSP.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactgggccaggggaccctggtcaccgtctcctcagcttccaccaagggcccatcggtcttcccctggcgccctgctccaggagcacctctgggggcacagcggccctgggctgcctggtcaaggactacttccgagtgcgtct

SEQ ID NO: 452325 - DNA, 390 bp, Homo sapiens; identical to SEQ ID NO: 444654
  misc_feature: HEFZJCU01E0EFE.16.17.B06.1.454.heavy.3.raw

SEQ ID NO: 452326 - DNA, 519 bp, Homo sapiens
  misc_feature: HEFZJCU01DOBIC.16.86.H09.1.454.heavy.3.raw
  modified_base (496)..(496): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgatagcagtggctggtccacttaggtttgactactggggccagggancttggtcaccgtctcctcagcct

SEQ ID NO: 452327 - DNA, 524 bp, Homo sapiens; identical to SEQ ID NO: 445902
  misc_feature: HEFZJCU01DNPVB.9.78.H01.1.454.heavy.3.raw

SEQ ID NO: 452328 - DNA, 416 bp, Homo sapiens
  misc_feature: HEFZJCU01D0JRR.51.77.G11.1.454.heavy.3.raw
cgatcgtatacacgaccggtgctcgatttagctagtcactcaagggaaagggactggagtggattggatatagtctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctggggacacagcggccctgggctgcctggtcaaggactacttcctcgtagcact

SEQ ID NO: 452329 - DNA, 495 bp, Homo sapiens
  misc_feature: HEFZJCU01EMRY6.51.29.C07.1.454.heavy.3.raw
cgatcgtatacacgaccggtgctcgatttagagtgctacgaagggaaaggggacagtgagtctccctcactgcccagctgggatctcagggcttcattttctgtcctccaccatcatggggtcaaccgccatcctcgccctcctcctggctgttctccaaggagtctgtgccgaggagcagctggtgcagactggaacagaggtgaaaagccgggggagtctctgaagatctcctgtaagggttctggacacagctttatcaactactggatcggctgggtgcgccagatgcccgggaaaggcctggagtggatgggcatcatctatcctggtgactctgatgtcagatacagcccgtccttccgcggccaggtcaccttctcagccgacaagtccatcgacaccgtctacctgcagtggagcagcctgaaggcctcggacaccgccatgtattactgtgcgagacagacaagagacggctacaatttggctttt

SEQ ID NO: 452330 - DNA, 527 bp, Homo sapiens
  misc_feature: HEFZJCU01A3KKV.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagtgggagcaccaactacaaccctccctcaagagtcgagtcaccatatcagtggacacgtccaagaaccagttctccctgaagctgagctctgtgaccgctgcggacacggccgtgtattactgtgcgagctggggttcagggtactttgactactggggccagggaaccctggtcaccgtctcctcagcctccaccaaggcccatcggtcttcccctggccaccctcctccaagacgcacctcgtcggggcacagcggccctgggctgcctggtcaaggactacttcctagtcgt

SEQ ID NO: 452331 - DNA, 493 bp, Homo sapiens
  misc_feature: HEFZJCU01CWBWJ.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctggggcacagcgccctggctgcctggtcaaggactacttccgagtagtaca

SEQ ID NO: 452332 - DNA, 400 bp, Homo sapiens; identical to SEQ ID NO: 444452
  misc_feature: HEFZJCU01A33ZU.47.24.C02.1.454.heavy.3.raw

SEQ ID NO: 452333 - DNA, 508 bp, Homo sapiens; identical to SEQ ID NO: 445230
  misc_feature: HEFZJCU01DC74P.14.25.C03.1.454.heavy.3.raw

SEQ ID NO: 452334 - DNA, 414 bp, Homo sapiens; identical to SEQ ID NO: 444982
  misc_feature: HEFZJCU01BU0AA.5.23.C01.1.454.heavy.3.raw

SEQ ID NO: 452335 - DNA, 518 bp, Homo sapiens; identical to SEQ ID NO: 445423
  misc_feature: HEFZJCU01CEG41.7.78.H01.1.454.heavy.3.raw

SEQ ID NO: 452336 - DNA, 395 bp, Homo sapiens
  misc_feature: HEFZJCU01D6MYN.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactactttctacgtgagct

SEQ ID NO: 452337 - DNA, 506 bp, Homo sapiens; identical to SEQ ID NO: 444696
  misc_feature: HEFZJCU01BA0PO.16.34.D01.1.454.heavy.3.raw

SEQ ID NO: 452338 - DNA, 509 bp, Homo sapiens; identical to SEQ ID NO: 447324
  misc_feature: HEFZJCU01AQBRC.18.39.D06.1.454.heavy.3.raw

SEQ ID NO: 452339 - DNA, 500 bp, Homo sapiens
  misc_feature: HEFZJCU01EFM3N.22.86.H09.1.454.heavy.3.raw
acatacgcgtcacgaccggtgctcgatttagtgctatagacttgggtttgggctgagcgtggttttcgtcgttaggctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccagggacactggtcacgtctcttcagcctccaccaagggcccatcggtcttcccctggcgccctgctcc

SEQ ID NO: 452340 - DNA, 489 bp, Homo sapiens
  misc_feature: HEFZJCU01DZM7M.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaggtggctacaatcaac

SEQ ID NO: 452341 - DNA, 483 bp, Homo sapiens; identical to SEQ ID NO: 444639
  misc_feature: HEFZJCU01EE03R.11.23.C01.1.454.heavy.3.raw

SEQ ID NO: 452342 - DNA, 512 bp, Homo sapiens
  misc_feature: HEFZJCU01EFS6F.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaagggcccatccggtcttcccctggccaccctcctaccc

SEQ ID NO: 452343 - DNA, 492 bp, Homo sapiens
  misc_feature: HEFZJCU01CORKF.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccaccgagagta

SEQ ID NO: 452344 - DNA, 387 bp, Homo sapiens; identical to SEQ ID NO: 444635
  misc_feature: HEFZJCU01CJGR4.11.27.C05.1.454.heavy.3.raw

SEQ ID NO: 452345 - DNA, 504 bp, Homo sapiens
  misc_feature: HEFZJCU01DFZDB.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaagggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 452346 - DNA, 548 bp, Homo sapiens
  misc_feature: HEFZJCU01BLSCL.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacagccggggggtccctgagactctcctgtgcagcctctggattcaattttaacagctttgccatgggctgggtccgccaggctccagggaagggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggcgtggatcgggggtagtttgggttccgtggggccgaggggaacccgtgggtccg

SEQ ID NO: 452347 - DNA, 318 bp, Homo sapiens
  misc_feature: HEFZJCU01EPN73.13.66.F11.1.454.heavy.3.raw
tcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtga

SEQ ID NO: 452348 - DNA, 537 bp, Homo sapiens
  misc_feature: HEFZJCU01B46XC.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactccctgaaagcgtcaactactactactacggtatggacctcgtggggaccg

SEQ ID NO: 452349 - DNA, 533 bp, Homo sapiens
  misc_feature: HEFZJCU01BZFD1.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatgggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggg

SEQ ID NO: 452350 - DNA, 400 bp, Homo sapiens
  misc_feature: HEFZJCU01A7V9O.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaagagcacctctgggggcacagcggccctgggctgcctggtcaaggactacttcctacgtgagct

SEQ ID NO: 452351 - DNA, 505 bp, Homo sapiens; identical to SEQ ID NO: 449275
  misc_feature: HEFZJCU01D9V3U.13.39.D06.1.454.heavy.3.raw

SEQ ID NO: 452352 - DNA, 513 bp, Homo sapiens; identical to SEQ ID NO: 446452
  misc_feature: HEFZJCU01BNQBU.17.33.C11.1.454.heavy.3.raw

SEQ ID NO: 452353 - DNA, 488 bp, Homo sapiens; identical to SEQ ID NO: 444617
  misc_feature: HEFZJCU01CJ4KE.4.6.A06.1.454.heavy.3.raw

SEQ ID NO: 452354 - DNA, 528 bp, Homo sapiens
  misc_feature: HEFZJCU01AID4W.48.4.A04.1.454.heavy.3.raw
agtatacatacacgaccggtgctcgatttagagtagtgatcaggggagtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcggggtggctacgacttgacttttggggccaggggaaacctggtccaccgtcctccccagccttccaccaacgggcccatccggttcc

SEQ ID NO: 452355 - DNA, 507 bp, Homo sapiens
  misc_feature: HEFZJCU01C0891.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctgtcgtat

SEQ ID NO: 452356 - DNA, 492 bp, Homo sapiens
  misc_feature: HEFZJCU01C8O3S.14.25.C03.1.454.heavy.3.raw
  modified_base (473)..(473): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtggganagatggaggtcgatattgt

SEQ ID NO: 452357 - DNA, 512 bp, Homo sapiens; identical to SEQ ID NO: 445688
  misc_feature: HEFZJCU01ED2Q1.3.34.D01.1.454.heavy.3.raw

SEQ ID NO: 452358 - DNA, 491 bp, Homo sapiens; identical to SEQ ID NO: 447981
  misc_feature: HEFZJCU01CGCSO.47.85.H08.1.454.heavy.3.raw

SEQ ID NO: 452359 - DNA, 524 bp, Homo sapiens
  misc_feature: HEFZJCU01COFZS.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcc

SEQ ID NO: 452360 - DNA, 503 bp, Homo sapiens; identical to SEQ ID NO: 445995
  misc_feature: HEFZJCU01CIZZO.17.25.C03.1.454.heavy.3.raw

SEQ ID NO: 452361 - DNA, 482 bp, Homo sapiens
  misc_feature: HEFZJCU01DI5BW.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatggggctcaaaccaaatttttcactactggggccagggatccctggtcgccgtcggctcagcctccaccaagggcccatcggtcttccccctggcgccctgctccaggagcacctccgagagcacagcggccctgggctgcctggtcaaggactacttcctacgtgagct

SEQ ID NO: 452362 - DNA, 378 bp, Homo sapiens
  misc_feature: HEFZJCU01CLK0U.7.37.D04.1.454.heavy.3.raw
cgtgtctctacacgaccggtgctcgatttagtagcatactgttgggtttgggtggccgaaatcaccggagatggaggtgtgcaatactatgcggactctgtgaggggccgattcactgtctccagagacaacaccaagaacttcactgtatcttgcaaatgaacagcctgagagtcgaggacagtggtggtatattactgtgcgagccccggcgcttttgggcggaattcgggactgtggggccagggaaccctggtcagcgtctcagcctccaccaagggcccatcggtcttccccctggcgccctgctccaggagcacctccggagagcacagcggccctgggctgcctggtcaaggactacttcctagagacacg

SEQ ID NO: 452363 - DNA, 507 bp, Homo sapiens
  misc_feature: HEFZJCU01DZQJW.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctcgtgggggcacagcggccctggactgcctggtcaaggactacttccgagtagtaca

SEQ ID NO: 452364 - DNA, 506 bp, Homo sapiens
  misc_feature: HEFZJCU01EZ346.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagaggggtttgactggaactccttctacatggacgtctggggcaaagggaccg

SEQ ID NO: 452365 - DNA, 510 bp, Homo sapiens
  misc_feature: HEFZJCU01DUTFA.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagttgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccggatattgttatagaaccacctgctatctgagctggttcgactgctggggccagggaaccctggtcaccg

SEQ ID NO: 452366 - DNA, 531 bp, Homo sapiens; identical to SEQ ID NO: 446857
  misc_feature: HEFZJCU01DT2H2.7.78.H01.1.454.heavy.3.raw

SEQ ID NO: 452367 - DNA, 504 bp, Homo sapiens; identical to SEQ ID NO: 447910
  misc_feature: HEFZJCU01BKE0L.10.38.D05.1.454.heavy.3.raw

SEQ ID NO: 452368 - DNA, 518 bp, Homo sapiens
  misc_feature: HEFZJCU01B0RBL.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacagggtcctgtcccaggtgcaaccacaccactggggcgcaggactgttgaagcctccggagaccctgtccctcacctgcgctgtctgtggtgggtccttcagtgactactactgagactagatccgccagtccccagggaaggggctggaatggattcgacagggtcaatcattacagatccaccaactacaacccgtccctcagcagtcgagtcaccttttcgcttgacacgtccaacaaccagttttctctgatcaaacccgagaccgccgcgacagcctcggccctggggcccagaaacccg

SEQ ID NO: 452369 - DNA, 498 bp, Homo sapiens
  misc_feature: HEFZJCU01DG223.48.71.G05.1.454.heavy.3.raw
agtatacatacacgaccggtgctcgatttagtgtcgtcgcaagagagaggggacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggaggggagactggttcg

SEQ ID NO: 452370 - DNA, 483 bp, Homo sapiens; identical to SEQ ID NO: 444639
  misc_feature: HEFZJCU01B5GFY.11.23.C01.1.454.heavy.3.raw

SEQ ID NO: 452371 - DNA, 524 bp, Homo sapiens; identical to SEQ ID NO: 446401
  misc_feature: HEFZJCU01A4Q9L.3.82.H05.1.454.heavy.3.raw

SEQ ID NO: 452372 - DNA, 495 bp, Homo sapiens
  misc_feature: HEFZJCU01C0Y9Q.11.71.G05.1.454.heavy.3.raw
  modified_base (477)..(477): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattctgtgcgaaagntttcatagaggtgactac

SEQ ID NO: 452373 - DNA, 503 bp, Homo sapiens; identical to SEQ ID NO: 450415
  misc_feature: HEFZJCU01BKQN9.15.55.E11.1.454.heavy.3.raw

SEQ ID NO: 452374 - DNA, 368 bp, Homo sapiens; identical to SEQ ID NO: 449414
  misc_feature: HEFZJCU01DDQO0.19.53.E09.1.454.heavy.3.raw

SEQ ID NO: 452375 - DNA, 514 bp, Homo sapiens
  misc_feature: HEFZJCU01EJ8IN.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtccaccgtctcctcacg

SEQ ID NO: 452376 - DNA, 315 bp, Homo sapiens; identical to SEQ ID NO: 444763
  misc_feature: HEFZJCU01BH0AU.47.56.F01.1.454.heavy.3.raw

SEQ ID NO: 452377 - DNA, 491 bp, Homo sapiens
  misc_feature: HEFZJCU01A53DY.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccatcggtcttcccctggcgccctgctccaggagcacctccgagagcacagcggccctgggctgcctggtcaaggactacttccctacagtgct

SEQ ID NO: 452378 - DNA, 519 bp, Homo sapiens; identical to SEQ ID NO: 444867
  misc_feature: HEFZJCU01D6LU3.9.34.D01.1.454.heavy.3.raw

SEQ ID NO: 452379 - DNA, 532 bp, Homo sapiens
  misc_feature: HEFZJCU01B88V9.48.27.C05.1.454.heavy.3.raw
agtatacatacacgaccggtgctcgatttagacgcgatcgaagggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctcggtcgccgttt

SEQ ID NO: 452380 - DNA, 534 bp, Homo sapiens
  misc_feature: HEFZJCU01BZYJ0.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgctggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaaggcccatcggtcttcccctggcaccctcctccaagagcacctctgggggcac

SEQ ID NO: 452381 - DNA, 508 bp, Homo sapiens; identical to SEQ ID NO: 445594
  misc_feature: HEFZJCU01A24IQ.17.25.C03.1.454.heavy.3.raw

SEQ ID NO: 452382 - DNA, 467 bp, Homo sapiens
  misc_feature: HEFZJCU01B5RME.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggtcggttctccatctccagagacacttccaagaacacgctgtatttgcaaatgaacagtctgagagtcgaggacacggccatatattactgtgcgaagcgggaattggtggcggtgactgctattgactactgggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 452383 - DNA, 515 bp, Homo sapiens
  misc_feature: HEFZJCU01B3CVS.16.71.G05.1.454.heavy.3.raw
  modified_base (461)..(461): a, c, t, g, unknown or other
tgtactactccacgaccggtgctcgatttagtgtcgtcgcaagagagaggggcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattacngtgcgaaagcaccggcagttagtcacccatactactttgacctactggggccac

SEQ ID NO: 452384 - DNA, 518 bp, Homo sapiens
  misc_feature: HEFZJCU01DVYZA.12.71.G05.1.454.heavy.3.raw
  modified_base (464)..(464): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatattcgacccctggggccagggaacccaggtcaccgtctcctcagcctccaccaagggcccatccgtcttcccctggcgccctgctccagngcacctccgagagcacagcgccctgggctgcctggtcaaggactactcctaccg

SEQ ID NO: 452385 - DNA, 513 bp, Homo sapiens
  misc_feature: HEFZJCU01C5NPE.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctggggcacagcc

SEQ ID NO: 452386 - DNA, 508 bp, Homo sapiens; identical to SEQ ID NO: 446002
  misc_feature: HEFZJCU01C46IL.9.78.H01.1.454.heavy.3.raw

SEQ ID NO: 452387 - DNA, 531 bp, Homo sapiens; identical to SEQ ID NO: 446857
  misc_feature: HEFZJCU01BH4DF.7.78.H01.1.454.heavy.3.raw

SEQ ID NO: 452388 - DNA, 489 bp, Homo sapiens; identical to SEQ ID NO: 444591
  misc_feature: HEFZJCU01CUNFZ.18.70.G04.1.454.heavy.3.raw

SEQ ID NO: 452389 - DNA, 518 bp, Homo sapiens
  misc_feature: HEFZJCU01A7OUV.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaacacgctgtatctgcaaatgaacggcctgagagccgaggacacggccgtatattactgtgcccgagggaggttttactatgatattactggttacaaaaaagggtactactttgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 452390 - DNA, 488 bp, Homo sapiens
  misc_feature: HEFZJCU01BJ2VY.49.82.H05.1.454.heavy.3.raw
agtcgagagacacgaccggtgctcgatttagtcgagctctctcgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaac

SEQ ID NO: 452391 - DNA, 526 bp, Homo sapiens; identical to SEQ ID NO: 447476
  misc_feature: HEFZJCU01DQILG.14.55.E11.1.454.heavy.3.raw

SEQ ID NO: 452392 - DNA, 530 bp, Homo sapiens
  misc_feature: HEFZJCU01DGR5M.13.10.A10.1.454.heavy.3.raw
tcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatctgggggaggcttggtcaagccgggggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatatta

SEQ ID NO: 452393 - DNA, 533 bp, Homo sapiens
  misc_feature: HEFZJCU01DN2M5.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccgtggggcccggggtaacccgtggtcaccgtctcccccacccctccaacccg

SEQ ID NO: 452394 - DNA, 502 bp, Homo sapiens
  misc_feature: HEFZJCU01D3KVB.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgacccctggggccagggaaccctagtcaccgtctcctcagcctccaccaagggcccatcggtcttcccctggcgccctgctccaggagcacctccgacgag

SEQ ID NO: 452395 - DNA, 518 bp, Homo sapiens
  misc_feature: HEFZJCU01AP9UH.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactactggggccaggggatccctggtcaccgtctcctcagcctccaccaacgggccatcggtcttcccctcgg

SEQ ID NO: 452396 - DNA, 521 bp, Homo sapiens; identical to SEQ ID NO: 446749
  misc_feature: HEFZJCU01CWVN0.9.63.F08.1.454.heavy.3.raw

SEQ ID NO: 452397 - DNA, 513 bp, Homo sapiens
  misc_feature: HEFZJCU01EMW0K.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggtaacccg

SEQ ID NO: 452398 - DNA, 396 bp, Homo sapiens; identical to SEQ ID NO: 444433
  misc_feature: HEFZJCU01AZO9E.47.59.F04.1.454.heavy.3.raw

SEQ ID NO: 452399 - DNA, 501 bp, Homo sapiens
  misc_feature: HEFZJCU01CYR7U.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggaccg

SEQ ID NO: 452400 - DNA, 534 bp, Homo sapiens
  misc_feature: HEFZJCU01C9EI5.51.26.C04.1.454.heavy.3.raw
cgatcgtatacacgaccggtgctcgatttagtctagcgactttgggtttgggctgagcgtggttttcctcgttagctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacgggtcaccgtctccttagcctccaccaaggcccatcggtcttcccctggcaccctcctccaagacgcacctctc

SEQ ID NO: 452401 - DNA, 484 bp, Homo sapiens
  misc_feature: HEFZJCU01B9R3K.40.71.G05.1.454.heavy.3.raw
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagcctgacatctgacgacacggccgtatattactgtgcgagagatcatcggaggtggaatggccgtgt

SEQ ID NO: 452402 - DNA, 470 bp, Homo sapiens; identical to SEQ ID NO: 444866
  misc_feature: HEFZJCU01DZEUQ.4.36.D03.1.454.heavy.3.raw

SEQ ID NO: 452403 - DNA, 521 bp, Homo sapiens
  misc_feature: HEFZJCU01APELG.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtcgtggggccgaggggacctaac

SEQ ID NO: 452404 - DNA, 479 bp, Homo sapiens
  misc_feature: HEFZJCU01EZBA5.49.82.H05.1.454.heavy.3.raw
agtcgagagacacgaccggtgctcgatttagtcgagctctctcgcgggcacgaccggtgctcgatttagctctacgctcagggcacgaccggtgctcgatttagtgtagtgtgaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaaggcccatcggtctccccctggcaccctcctccaagagcacctctgggggcacagcggccctgggctgcctggtcaaggactacttcctctctcgact

SEQ ID NO: 452405 - DNA, 374 bp, Homo sapiens
  misc_feature: HEFZJCU01EFD6P.13.5.A05.1.454.heavy.3.raw
tcacgtactacacgaccggtgctcgatttagatagatagacagggggaggcattagacattacgcagactccgtgaagggccgattcacagtttccagagacaattccaagaatacggtgtttctgcaaatggacagcctgcggggcgacgacacggctaaatattactgtacgagagaccatttccatgactatggtgtctctcccggattttacaagggcatgggcgtctggggccaagggactaccgttaccgtcgccgcagcctccaccaagggcccatcggtcttccccctggcgccctgctccaggagcacctccgagagcacagcggccctgggctgcctggtcaaggactacttcctagtacgtga

SEQ ID NO: 452406 - DNA, 495 bp, Homo sapiens
  misc_feature: HEFZJCU01BXEP1.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcacctcctccaagagcacctctgggggcacagcggccctgggctgcctggtcaaggactacttccgagtagtaca

SEQ ID NO: 452407 - DNA, 496 bp, Homo sapiens
  misc_feature: HEFZJCU01CWR1I.52.77.G11.1.454.heavy.3.raw
cgcagtacgacacgaccggtgctcgatttagctagtcactcaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaatgaacagcctgagagccgaggacacggctgtgtattactgtgcgaacttaatcacggaggaaccg

SEQ ID NO: 452408 - DNA, 506 bp, Homo sapiens
  misc_feature: HEFZJCU01DB06U.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 452409 - DNA, 491 bp, Homo sapiens
  misc_feature: HEFZJCU01DN13C.12.55.E11.1.454.heavy.3.raw
  modified_base (472)..(472): a, c, t, g, unknown or other
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtaatcttcaaataaacagtctgagacttgaggacacggctgtctattactgtgcgagagactacggtgaccttttctggtatttcgatctctggggccgtggcaccctggtcactgtctctcggcttccacaaggccntgtcttccctcgcgcctcg

SEQ ID NO: 452410 - DNA, 503 bp, Homo sapiens
  misc_feature: HEFZJCU01EZHGK.51.7.A07.1.454.heavy.3.raw
cgatcgtatacacgaccggtgctcgatttagcacgtgtcgcaggggtccgggagaggagcccagcactagaagtcggcggtgtttccactcggtgatgagcactgaacacagaggactcaccatggagtttgggctgagctgggttttcctcgttgctcttttaagaggtgtccagtgtcaggtgcacctggtggaatctgggggaggcgtggtccagcctgggaggtccctgagactctcttgtgtaggctctggattcagcttcagcaactatggcatgcactgggtccgccaggccccaggcgaggggctgcagtgggtggcagttatatcgtctgatgcaagtaatgaacattatggagaatccgtgaagggccgattcaccatctccagagacaattccaggaacacggtgtttctgcaaatgaacaggctgatacctgaggacacggctgtctattattgtgtgaagggtcccgtgacaaacttcggagtacttcct

SEQ ID NO: 452411 - DNA, 515 bp, Homo sapiens
  misc_feature: HEFZJCU01BS5MP.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggcc

SEQ ID NO: 452412 - DNA, 507 bp, Homo sapiens
  misc_feature: HEFZJCU01C4D8E.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatgggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctggggccac

SEQ ID NO: 452413 - DNA, 491 bp, Homo sapiens; identical to SEQ ID NO: 445333
  misc_feature: HEFZJCU01BUH20.19.53.E09.1.454.heavy.3.raw

SEQ ID NO: 452414 - DNA, 495 bp, Homo sapiens
  misc_feature: HEFZJCU01BRHR9.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaaggtgaggagcctgagatatgacgacacggccgtgtattattgtgcgagagtggagtggcagtggatatcgaacaaattactactt

SEQ ID NO: 452415 - DNA, 341 bp, Homo sapiens
  misc_feature: HEFZJCU01A618W.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtgggggcaaagggaccacggtcaccgtcgtcctcagcctccaccaagggcccatcggtcttccccctggcaccctcctccaagagcacctctgggggcacagcggccctgggctgcctggtcaaggactacttcctacgtgagct

SEQ ID NO: 452416 - DNA, 385 bp, Homo sapiens; identical to SEQ ID NO: 445158
  misc_feature: HEFZJCU01CTKT9.27.46.E02.1.454.heavy.3.raw

SEQ ID NO: 452417 - DNA, 514 bp, Homo sapiens
  misc_feature: HEFZJCU01EWNRK.10.53.E09.1.454.heavy.3.raw
catagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctccaaagacaatttgaagaacacgctgtttctgcaaatgaacagcctgagagctgaggacgacggcgtgtgtattactgttcgtttggttctgactcgtcgggggaataccttc

SEQ ID NO: 452418 - DNA, 533 bp, Homo sapiens
  misc_feature: HEFZJCU01DQLUZ.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcacttatttatagtggtggtaccacatactacactagactccgtgaagggccgattcaccatctcagaagacaattccaggaacacattgtatcttcaaatgaataacctgagagccgaggacacggccatgtattacttgtgtggggcatttacttgacccctggggccggggaacccgtggtcaccgtcctccccaccctccacccg

SEQ ID NO: 452419 - DNA, 526 bp, Homo sapiens
  misc_feature: HEFZJCU01EW641.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggaccgtttggggtttcgaccccgtggggccagggaaccctggtcaccgtctcctcagcctccaccaaggcccatcggtcttcccctcggcaccctcctccaagagcacctctgggggcacagcc

SEQ ID NO: 452420 - DNA, 512 bp, Homo sapiens; identical to SEQ ID NO: 445688
  misc_feature: HEFZJCU01CWK8U.3.34.D01.1.454.heavy.3.raw

SEQ ID NO: 452421 - DNA, 379 bp, Homo sapiens; identical to SEQ ID NO: 444773
  misc_feature: HEFZJCU01BXDCY.3.59.F04.1.454.heavy.3.raw

SEQ ID NO: 452422 - DNA, 510 bp, Homo sapiens
  misc_feature: HEFZJCU01D8JLG.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctgcgcctgctccaggagcacctctggggcacagcggccg

SEQ ID NO: 452423 - DNA, 484 bp, Homo sapiens
  misc_feature: HEFZJCU01ACN77.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggccgccctgctccaggagcacctccgagagcacagcggccctgggctgcctggtcaaggactacttcctacgtgagct

SEQ ID NO: 452424 - DNA, 519 bp, Homo sapiens; identical to SEQ ID NO: 450177
  misc_feature: HEFZJCU01AER39.9.34.D01.1.454.heavy.3.raw

SEQ ID NO: 452425 - DNA, 522 bp, Homo sapiens
  misc_feature: HEFZJCU01BH31R.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggcgtggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtcgtggggccaagggagcactgtcaccgtctcctcacgcctccaccgaacgggcccagtcggtccttccccctcggccacccctcctacccg

SEQ ID NO: 452426 - DNA, 545 bp, Homo sapiens
  misc_feature: HEFZJCU01BBF2C.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctcaagagcacctcgtcggggcacagccgccgtcggctcgtccgtggtacgaaggtacctaccttccgtaggttagtaccacgtgacggccggggcgtcgggacgaac

SEQ ID NO: 452427 - DNA, 483 bp, Homo sapiens
  misc_feature: HEFZJCU01AMO0L.49.27.C05.1.454.heavy.3.raw
agtcgagagacacgaccggtgctcgatttagacgcgatcgaagggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgtaaa

SEQ ID NO: 452428 - DNA, 555 bp, Homo sapiens
  misc_feature: HEFZJCU01BXG2F.48.40.D07.1.454.heavy.3.raw
agtatacatacacgaccggtgctcgatttagtgatagagcgtaacaacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaataacgcggactccgtgaaaggccgcttcaccgtctccagagacaacggcgagaatactctgtattttgcagatgagaaatctgagaggcgaggacaccgcgctttattattgtacaacgtcgttttacttttctaatggtggctcttacgaacgacatgactattggggtcgggaaccctggtcaccgtctcctcagcctccaccaagggcccatcggtccttcccccttggccaccctcctaccaacgagccacctcgtc

SEQ ID NO: 452429 - DNA, 510 bp, Homo sapiens
  misc_feature: HEFZJCU01ES82T.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcagcctccaccaacgggcccatcggtccttcccctcggccaccctcct

SEQ ID NO: 452430 - DNA, 528 bp, Homo sapiens
  misc_feature: HEFZJCU01ET32J.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttcccctggcaccctcctccaagagcacctctgggggcacagcggcctgggctgcctggtcaaggactacttaccg

SEQ ID NO: 452431 - DNA, 514 bp, Homo sapiens
  misc_feature: HEFZJCU01BUSF6.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctgggggccaggggaacccctggtcaccg

SEQ ID NO: 452432 - DNA, 502 bp, Homo sapiens
  misc_feature: HEFZJCU01EKBF7.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaggactacttccgctacgtaga

SEQ ID NO: 452433 - DNA, 527 bp, Homo sapiens
  misc_feature: HEFZJCU01DAT17.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggagccggggaaccctggtcaccgtctccccaccctccaccaagggcccatcggtcttccccctggcaccctcctccaagagcacctctgggggcacagcggccctgggctgcctggtcaaggactacttccatactcgta

SEQ ID NO: 452434 - DNA, 407 bp, Homo sapiens
  misc_feature: HEFZJCU01C90LI.51.71.G05.1.454.heavy.3.raw
cgatcgtatacacgaccggtgctcgatttagtgtcgtcgcaagagagaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtaaggactacttcctcgtagcact

SEQ ID NO: 452435 - DNA, 532 bp, Homo sapiens
  misc_feature: HEFZJCU01DJGFR.11.13.B02.1.454.heavy.3.raw
  modified_base (437)..(437): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcactcgtctcctacncgtcctccaaccgacggacctacgtcgttcccttccccgtggccgtccgtcgtcctccgaggcgacctacctccgaagcgacacgacggccggcc

SEQ ID NO: 452436 - DNA, 495 bp, Homo sapiens; identical to SEQ ID NO: 446614
  misc_feature: HEFZJCU01CGUEN.13.85.H08.1.454.heavy.3.raw

SEQ ID NO: 452437 - DNA, 512 bp, Homo sapiens
  misc_feature: HEFZJCU01D9Z5K.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggcctctattactgtgcgagacgtcccacgactccgggtgacgcctacggcaggcggtccttttgacctttcgtc

SEQ ID NO: 452438 - DNA, 387 bp, Homo sapiens; identical to SEQ ID NO: 445170
  misc_feature: HEFZJCU01A4S3H.27.46.E02.1.454.heavy.3.raw

SEQ ID NO: 452439 - DNA, 484 bp, Homo sapiens; identical to SEQ ID NO: 449584
  misc_feature: HEFZJCU01C7JGL.10.35.D02.1.454.heavy.3.raw

SEQ ID NO: 452440 - DNA, 508 bp, Homo sapiens
  misc_feature: HEFZJCU01ED3YU.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaacagcggagttccaagtactccttgacgtctggg

SEQ ID NO: 452441 - DNA, 407 bp, Homo sapiens; identical to SEQ ID NO: 448569
  misc_feature: HEFZJCU01C7U5V.49.61.F06.1.454.heavy.3.raw

SEQ ID NO: 452442 - DNA, 511 bp, Homo sapiens; identical to SEQ ID NO: 447235
  misc_feature: HEFZJCU01D382P.16.21.B10.1.454.heavy.3.raw

SEQ ID NO: 452443 - DNA, 524 bp, Homo sapiens
  misc_feature: HEFZJCU01D25SR.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccagggggaccctggtcatcgtctccccagcctccaccaacgggcccatcggtcttccccctgccg

SEQ ID NO: 452444 - DNA, 517 bp, Homo sapiens
  misc_feature: HEFZJCU01BGMIQ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctgtcaaggactacttccagacgtatca

SEQ ID NO: 452445 - DNA, 507 bp, Homo sapiens
  misc_feature: HEFZJCU01DQCGB.47.48.E04.1.454.heavy.3.raw
agctcacgtacacgaccggtgctcgatttagagagcgtcacagagagaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggt

SEQ ID NO: 452446 - DNA, 526 bp, Homo sapiens
  misc_feature: HEFZJCU01BN2EC.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaaggcccatcggtcttcccctggcgccctgctccaggagcacctccgagacg

SEQ ID NO: 452447 - DNA, 324 bp, Homo sapiens
  misc_feature: HEFZJCU01DH9GK.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagaacctccgagagcacagcggccctgggctgcctggtcaaggactacttcccatactcgta

SEQ ID NO: 452448 - DNA, 502 bp, Homo sapiens; identical to SEQ ID NO: 450016
  misc_feature: HEFZJCU01DAWT4.17.10.A10.1.454.heavy.3.raw

SEQ ID NO: 452449 - DNA, 508 bp, Homo sapiens
  misc_feature: HEFZJCU01D2DXD.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacacgcggccc

SEQ ID NO: 452450 - DNA, 529 bp, Homo sapiens; identical to SEQ ID NO: 446480
  misc_feature: HEFZJCU01EK573.18.33.C11.1.454.heavy.3.raw

SEQ ID NO: 452451 - DNA, 497 bp, Homo sapiens
  misc_feature: HEFZJCU01CF9BG.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctggaggacacggtccttagtattactgtcgacaaggaggtaata

SEQ ID NO: 452452 - DNA, 540 bp, Homo sapiens
  misc_feature: HEFZJCU01EB1ZN.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggataatttagcctacgcggactccgtcaagggccgattcaccgtctccagagacaacaccaagaacacactatatctgcagattgacagtctgacgaccgaggacacggctgtgtattactgtgcgaaggctagttcgtaggaaactagttagtgggttggggggtagttttggggtttttttacgttacgttacgggt

SEQ ID NO: 452453 - DNA, 483 bp, Homo sapiens
  misc_feature: HEFZJCU01CH33I.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacacccttatctgcaaatagacagcctgagaccagacgacacggctgtctattattgcgcgagagagacacacgaacctactggccaatactatggggcttgttctggagccaggggaccctggtcatcgtctccccagcctccaccaagggcccatcggtcttcccctggcgccctgctccaggagcacctccgagagcacagcggccctgggctgcctggtcaaggactacttcctacgtcgtat

SEQ ID NO: 452454 - DNA, 503 bp, Homo sapiens; identical to SEQ ID NO: 445995
  misc_feature: HEFZJCU01AQTH4.17.25.C03.1.454.heavy.3.raw

SEQ ID NO: 452455 - DNA, 537 bp, Homo sapiens
  misc_feature: HEFZJCU01B4UZ6.51.38.D05.1.454.heavy.3.raw
cgatcgtatacacgaccggtgctcgatttagtatctgatagttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggccgaagggaccacggtcaccgttctccttagcctccaccaacgggcccatcggtccttccccgtggccaccctcctccaagagcacctc

SEQ ID NO: 452456 - DNA, 498 bp, Homo sapiens; identical to SEQ ID NO: 448023
  misc_feature: HEFZJCU01DJYVO.11.71.G05.1.454.heavy.3.raw

SEQ ID NO: 452457 - DNA, 506 bp, Homo sapiens
  misc_feature: HEFZJCU01BFA86.12.33.C11.1.454.heavy.3.raw
atacgacgtacacgaccggtgctcgatttagagtgagctcgttgggtttggggggaagaggaagactgacggtccctgagactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 452458 - DNA, 375 bp, Homo sapiens
  misc_feature: HEFZJCU01AD85Z.49.79.H02.1.454.heavy.3.raw
agtcgagagacacgaccggtgctcgatttagtgtcacacgaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 452459 - DNA, 530 bp, Homo sapiens; identical to SEQ ID NO: 447379
  misc_feature: HEFZJCU01DXB70.49.46.E02.1.454.heavy.3.raw

SEQ ID NO: 452460 - DNA, 534 bp, Homo sapiens
  misc_feature: HEFZJCU01ECBKY.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacggggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggccc

SEQ ID NO: 452461 - DNA, 396 bp, Homo sapiens; identical to SEQ ID NO: 444731
  misc_feature: HEFZJCU01BT3CN.18.61.F06.1.454.heavy.3.raw

SEQ ID NO: 452462 - DNA, 518 bp, Homo sapiens
  misc_feature: HEFZJCU01D1BDJ.13.4.A04.1.454.heavy.3.raw
tcacgtactacacgaccggtgctcgatttagagtagtgatcaggggtctgagagaggagcccagccctgggattttcaggtgttttcatttggtgatcaggactgaacagagagaactcaccatggaatttgggctgagctggctttttcttgtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggtaacccg

SEQ ID NO: 452463 - DNA, 469 bp, Homo sapiens
  misc_feature: HEFZJCU01DFNC1.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaaggcccatcggtcttcccctggcgccctgctccaggagcacctccgagagcacagcggccctgggctgcctggtcaaggactacttccctacagtgct

SEQ ID NO: 452464 - DNA, 485 bp, Homo sapiens
  misc_feature: HEFZJCU01CF6E0.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaggactacttcctcgtagcact

SEQ ID NO: 452465 - DNA, 518 bp, Homo sapiens
  misc_feature: HEFZJCU01EDI2T.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtacttccg

SEQ ID NO: 452466 - DNA, 467 bp, Homo sapiens
  misc_feature: HEFZJCU01BUNEL.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtctcccctggcgcctgctccaggagcacctccgagagcacagcggccctgggctgcctggtcaggactacttccctacagtgct

SEQ ID NO: 452467 - DNA, 514 bp, Homo sapiens
  misc_feature: HEFZJCU01D0NIR.48.78.H01.1.454.heavy.3.raw
agtatacatacacgaccggtgctcgatttagtgtgagtagtttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagatccaggcgaggaggataccgatttcttatatagcgactactactacttcggaatgg

SEQ ID NO: 452468 - DNA, 489 bp, Homo sapiens
  misc_feature: HEFZJCU01C48D1.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgattccccctccgtagagatggctacaaaatctttctccgaattgacttctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 452469 - DNA, 542 bp, Homo sapiens
  misc_feature: HEFZJCU01B5KB0.51.78.H01.1.454.heavy.3.raw
cgatcgtatacacgaccggtgctcgatttagtgtgagtagtttgggtttggggatggtggcagctcccagatgggtcctgtcccaggtgcagctgcaggagtcgggcccaggactggtgaagccttcggagaccctgaccctcacctgtactgtgtctgatgactccatcgggagttactactggacctggatccggaagcccccagggaagggactggagtggattggatatatctattataatgggaggaccgagtacaacccctccctcaagagtcgagtcaccatatcagttgactcctccaagaaccagttctccctgaggctgaactctgtgacctctgcggacacggccatgtatttctgtgcgaaagttcaggccccatcttattatgacgctagtggttatcaaataggggcctactttgactactggggccggggaacccgaggtcaccgtctcctcagcctccaccaaggcccatcggtcttcccctcggcaccctcctccaagacgcacctctgggggcacagcggcccg

SEQ ID NO: 452470 - DNA, 537 bp, Homo sapiens
  misc_feature: HEFZJCU01D7TW4.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattgggggccagggagccctggtctaccg

SEQ ID NO: 452471 - DNA, 396 bp, Homo sapiens; identical to SEQ ID NO: 444469
  misc_feature: HEFZJCU01EQ9LY.47.46.E02.1.454.heavy.3.raw

SEQ ID NO: 452472 - DNA, 513 bp, Homo sapiens
  misc_feature: HEFZJCU01CN85D.16.28.C06.1.454.heavy.3.raw
tgtactactccacgaccggtgctcgatttagagctcacgtattgggtttggggggaagaggaagactgacggtccctgagactctcctgtgcagcctctggattcccctttaccacatatgccatgggctgggtccgccaggctccagggaaggggctggagtgggtctcacttattagtggtagtggtggtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccaagggcccatcggtcttcccctggcgccctgctccaggagcacctccgagaacacagcggccctgggctgcctggtcaaggactacttccgagtagtaca

SEQ ID NO: 452473 - DNA, 330 bp, Homo sapiens; identical to SEQ ID NO: 445264
  misc_feature: HEFZJCU01DLKK5.53.44.D11.1.454.heavy.3.raw

SEQ ID NO: 452474 - DNA, 518 bp, Homo sapiens; identical to SEQ ID NO: 444718
  misc_feature: HEFZJCU01DZK5W.9.34.D01.1.454.heavy.3.raw

SEQ ID NO: 452475 - DNA, 497 bp, Homo sapiens
  misc_feature: HEFZJCU01AEFLS.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgttttattactgtgcgcgggataggaggctcatcgtggatacaa

SEQ ID NO: 452476 - DNA, 493 bp, Homo sapiens
  misc_feature: HEFZJCU01ATS9T.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtggatggaagtcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggccgccctgctccaggagcacctccgagagcacagcggccctgggctgcctggtcaaggactacttcccatacctcgta

SEQ ID NO: 452477 - DNA, 508 bp, Homo sapiens; identical to SEQ ID NO: 445594
  misc_feature: HEFZJCU01AVBRO.17.25.C03.1.454.heavy.3.raw

SEQ ID NO: 452478 - DNA, 393 bp, Homo sapiens
  misc_feature: HEFZJCU01BZQNO.48.41.D08.1.454.heavy.3.raw
agtatacatacacgaccggtgctcgatttagtcacgcgagaaagggaaaggggctggagtggattgggagtatttaccacagtgggagcacctactacaacccgtccctcaaaagtcgaggcaccatatccgtagacacgtccaagaaccaattctccctgaagctgagctctgtgaccgccgcaggacacggctgtctattactgtgcgaggccccgagcgcagtggctttttgatgcctttgatatgtggggccaaggggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 452479 - DNA, 549 bp, Homo sapiens
  misc_feature: HEFZJCU01DIVJ6.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattacaaagaacacggcgtatctgcaaatgaacagcctgaaaaccgaggacacggccgtgtattactgtactagacaggtggattacagtttggggggtagttagtcgcgaaacgggggggtacgtaacgtacgtcg

SEQ ID NO: 452480 - DNA, 491 bp, Homo sapiens
  misc_feature: HEFZJCU01BN2SJ.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgttattactgtgggagaaatcctagt

SEQ ID NO: 452481 - DNA, 501 bp, Homo sapiens
  misc_feature: HEFZJCU01C67L8.49.62.F07.1.454.heavy.3.raw
agtcgagagacacgaccggtgctcgatttagtagtcgcataaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctggagtgggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagt

SEQ ID NO: 452482 - DNA, 505 bp, Homo sapiens
  misc_feature: HEFZJCU01DDMVD.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtgggccgaagggacaagtggtcaccgt

SEQ ID NO: 452483 - DNA, 517 bp, Homo sapiens
  misc_feature: HEFZJCU01BWUTS.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctggctgcctggtcaaggactacttcctagagacacg

SEQ ID NO: 452484 - DNA, 500 bp, Homo sapiens; identical to SEQ ID NO: 444529
  misc_feature: HEFZJCU01EX9LF.12.38.D05.1.454.heavy.3.raw

SEQ ID NO: 452485 - DNA, 401 bp, Homo sapiens
  misc_feature: HEFZJCU01AOL3J.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcaccgtcggtccgcttattactaccactcctacttggacgtctggggcaaagggaccgcggtcaccgtctcctcagcttccaccaagggcccatcggtcttccccctggcgccctgctccaggagcacctctgggggcacagcggccctgggctgcctggtcaaggactacttcctacgtgagct

SEQ ID NO: 452486 - DNA, 529 bp, Homo sapiens
  misc_feature: HEFZJCU01D4A52.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgattttggagtggtaaccccttggctactggggcagggaaccctggtcaccgtctcttcagcctccaccaagggcccacg

SEQ ID NO: 452487 - DNA, 502 bp, Homo sapiens
  misc_feature: HEFZJCU01EOSK4.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactac

SEQ ID NO: 452488 - DNA, 520 bp, Homo sapiens
  misc_feature: HEFZJCU01DTE6D.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctggggccaagggagcactgtcaccgtctcctcacgcctccaccaagggcccactccggtccttcccccgtcggccacccctcctacccg

SEQ ID NO: 452489 - DNA, 507 bp, Homo sapiens; identical to SEQ ID NO: 448429
  misc_feature: HEFZJCU01CVMS0.3.17.B06.1.454.heavy.3.raw

SEQ ID NO: 452490 - DNA, 500 bp, Homo sapiens; identical to SEQ ID NO: 447083
  misc_feature: HEFZJCU01D12MO.12.38.D05.1.454.heavy.3.raw

SEQ ID NO: 452491 - DNA, 486 bp, Homo sapiens; identical to SEQ ID NO: 444861
  misc_feature: HEFZJCU01DNDFV.47.55.E11.1.454.heavy.3.raw

SEQ ID NO: 452492 - DNA, 520 bp, Homo sapiens
  misc_feature: HEFZJCU01AINMD.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggccatccgtcttcccctggcgccctgctccaggagcacctccgagagcacagcggccctgggctgcctggtcaaggactacttcctacg

SEQ ID NO: 452493 - DNA, 523 bp, Homo sapiens
  misc_feature: HEFZJCU01D9EIB.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcgtcttcccctggcgccctgctccaggagcacctccgagagcacagcggccctgggc

SEQ ID NO: 452494 - DNA, 513 bp, Homo sapiens; identical to SEQ ID NO: 447518
  misc_feature: HEFZJCU01B8SOA.19.67.G01.1.454.heavy.3.raw

SEQ ID NO: 452495 - DNA, 495 bp, Homo sapiens; identical to SEQ ID NO: 446614
  misc_feature: HEFZJCU01BJC4F.13.85.H08.1.454.heavy.3.raw

SEQ ID NO: 452496 - DNA, 511 bp, Homo sapiens; identical to SEQ ID NO: 445268
  misc_feature: HEFZJCU01EDZO1.48.34.D01.1.454.heavy.3.raw

SEQ ID NO: 452497 - DNA, 474 bp, Homo sapiens
  misc_feature: HEFZJCU01CW664.10.38.D05.1.454.heavy.3.raw
catagtagtgcacgaccggtgctcgatttagtatctgatagttgggtttggggggaagaggaagactgagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctcccagcctccaccaagggcccatcggtcttcccctggcgccctgctccaggagcacctccgagagcacagcggccctgggctgcctggtcaaggactacttcccactactatg

SEQ ID NO: 452498 - DNA, 518 bp, Homo sapiens; identical to SEQ ID NO: 447436
  misc_feature: HEFZJCU01CR9V0.13.76.G10.1.454.heavy.3.raw

SEQ ID NO: 452499 - DNA, 516 bp, Homo sapiens
  misc_feature: HEFZJCU01BWO0S.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagcgtgggttttccttgttgctattttagaaggtgtccagtgcgaggagcagctggtggagtctgggggaggcctggtccagccgggggggtccctgagactctcctgtgccgcctctggactcacctttagtagctattggatgagctgggtccgccaggctccagggaaggggctggagtgggtggccaacataaaggaagatggaagtcagaaacactatgtggactctgcgaagggccgattcaccatctccagagacaacgccaagaattcagtgtatctgcaaatgaaacagcctgagagccgagggacacggccgtgtaattctgtgtgagagacatgacaacggtgataaccggaggggttg

SEQ ID NO: 452500 - DNA, 476 bp, Homo sapiens
  misc_feature: HEFZJCU01BVV9O.16.67.G01.1.454.heavy.3.raw
tgtactactccacgaccggtgctcgatttagagtatacatattgggtccctgagactctcctgtgcgacctctggattcacctttagcagctatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 452501 - DNA, 515 bp, Homo sapiens; identical to SEQ ID NO: 447834
  misc_feature: HEFZJCU01BWBXF.3.20.B09.1.454.heavy.3.raw

SEQ ID NO: 452502 - DNA, 524 bp, Homo sapiens
  misc_feature: HEFZJCU01A9U6L.48.34.D01.1.454.heavy.3.raw
agtatacatacacgaccggtgctcgatttagatcgtctgtgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctagcgccctgctccaggagcaccc

SEQ ID NO: 452503 - DNA, 544 bp, Homo sapiens
  misc_feature: HEFZJCU01D3WFL.52.35.D02.1.454.heavy.3.raw
cgcagtacgacacgaccggtgctcgatttagcacacgatagttgggtttgggctgagcgtggcgtctttacgttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtcttccccctggcaccctcctccaagag

SEQ ID NO: 452504 - DNA, 523 bp, Homo sapiens
  misc_feature: HEFZJCU01AZH33.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctacgtggggccaggggaaccctggtcaccgtctcttcagcctccacc

SEQ ID NO: 452505 - DNA, 495 bp, Homo sapiens
  misc_feature: HEFZJCU01EVV57.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaaacagcctgagagctgaggacacggctgtgtattactgtgggagagatgggaggtcgatattgta

SEQ ID NO: 452506 - DNA, 509 bp, Homo sapiens
  misc_feature: HEFZJCU01DQL6H.4.81.H04.1.454.heavy.3.raw
agcactgtagcacgaccggtgctcgatttagtagtgtagattcgcggggagctctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaataagggagctaccctacgatttggacac

SEQ ID NO: 452507 - DNA, 487 bp, Homo sapiens
  misc_feature: HEFZJCU01EGKEX.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtatttttgtgtgagagattttcggacaatccagagacccct

SEQ ID NO: 452508 - DNA, 513 bp, Homo sapiens
  misc_feature: HEFZJCU01D2C95.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcggagagtcccacgactccggtgagcctacggcaggccggtccttttggacctttcgtc

SEQ ID NO: 452509 - DNA, 534 bp, Homo sapiens; identical to SEQ ID NO: 445832
  misc_feature: HEFZJCU01BN5KQ.17.28.C06.1.454.heavy.3.raw

SEQ ID NO: 452510 - DNA, 529 bp, Homo sapiens
  misc_feature: HEFZJCU01DT5J2.8.34.D01.1.454.heavy.3.raw
ctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccagcgggagttccaagtactcctttgacgtctggggccagggtaccctggtcaccgtctcctcagcctccaccaagggcccatcggtcttcccctggcgccctgctccaggagcacctccgagagcac

SEQ ID NO: 452511 - DNA, 522 bp, Homo sapiens
  misc_feature: HEFZJCU01BMGAO.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtccaccgtctccctca

SEQ ID NO: 452512 - DNA, 520 bp, Homo sapiens
  misc_feature: HEFZJCU01B9WN9.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagaccgtatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 452513 - DNA, 500 bp, Homo sapiens; identical to SEQ ID NO: 445807
  misc_feature: HEFZJCU01D4SIZ.40.81.H04.1.454.heavy.3.raw

SEQ ID NO: 452514 - DNA, 506 bp, Homo sapiens
  misc_feature: HEFZJCU01ES5PE.51.56.F01.1.454.heavy.3.raw
cgatcgtatacacgaccggtgctcgatttagcagacgtctgaacacacaaagggggagcatcacccagcaaccacatctgtcctctagagaaccccctgagagccccgctcctcaccatggactggacctggaggatcctcttcttggtggcagcagccacaagagcccaatcccaggtgcaggtggtgcagtctggggctgaggtgaagaagcccggggcctcagcgaaggtctcctgcaagacctctggctacaccttcagtggcaacaacgtccactgggtgcgccaggcccctggacaaggacttgagtggatgggatggtttagtctgagaactggtgccgcaaattatgcacaggagtttcggggcagggtcgtcatgaccggggacacgtccatcgccacgacttacatggaactgaccagtctgacatttgacgacacggccgtctattactgtgcgacagaagcggcggacagaggttcgcttactggttcgaggct

SEQ ID NO: 452515 - DNA, 368 bp, Homo sapiens
  misc_feature: HEFZJCU01AM8VB.13.23.C01.1.454.heavy.3.raw
tcacgtactacacgaccggtgctcgatttagtacacgtgattagggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctggggcacagcggccctgggctgcctggtcaaggactacttcctagtacgtga

SEQ ID NO: 452516 - DNA, 481 bp, Homo sapiens; identical to SEQ ID NO: 448054
  misc_feature: HEFZJCU01BMVC5.22.36.D03.1.454.heavy.3.raw

SEQ ID NO: 452517 - DNA, 520 bp, Homo sapiens; identical to SEQ ID NO: 446725
  misc_feature: HEFZJCU01BR4MO.12.86.H09.1.454.heavy.3.raw

SEQ ID NO: 452518 - DNA, 396 bp, Homo sapiens
  misc_feature: HEFZJCU01BUBWV.47.42.D09.1.454.heavy.3.raw
agctcacgtacacgaccggtgctcgatttagacacatacgcagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 452519 - DNA, 412 bp, Homo sapiens; identical to SEQ ID NO: 444546
  misc_feature: HEFZJCU01A9SNB.13.30.C08.1.454.heavy.3.raw

SEQ ID NO: 452520 - DNA, 508 bp, Homo sapiens
  misc_feature: HEFZJCU01BG599.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattgggtacatctatcacaatgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 452521 - DNA, 503 bp, Homo sapiens; identical to SEQ ID NO: 445995
  misc_feature: HEFZJCU01E1NV9.17.25.C03.1.454.heavy.3.raw

SEQ ID NO: 452522 - DNA, 506 bp, Homo sapiens
  misc_feature: HEFZJCU01CK1Q3.22.86.H09.1.454.heavy.3.raw
acatacgcgtcacgaccggtgctcgatttagtgctatagacttgggtttgggctgagcgtggttttcgtcgttagctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaagcttttgatctctggggccaagggacactggtcaccgtctcttcagcctccaccaagggcccatcggtcttcccctggcgcctgctccaggacg

SEQ ID NO: 452523 - DNA, 500 bp, Homo sapiens; identical to SEQ ID NO: 447911
  misc_feature: HEFZJCU01CPJ3H.26.23.C01.1.454.heavy.3.raw

SEQ ID NO: 452524 - DNA, 513 bp, Homo sapiens
  misc_feature: HEFZJCU01EJKNW.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcgggagttccaagtactcctttg

SEQ ID NO: 452525 - DNA, 519 bp, Homo sapiens; identical to SEQ ID NO: 446650
  misc_feature: HEFZJCU01D9YOO.13.76.G10.1.454.heavy.3.raw

SEQ ID NO: 452526 - DNA, 534 bp, Homo sapiens
  misc_feature: HEFZJCU01BRB2M.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaagggcccatcggtcttcccctggccaccctcctccaagagcacctctgggggcacagcggccctgggctgcctggtcaaggactactt

SEQ ID NO: 452527 - DNA, 497 bp, Homo sapiens
  misc_feature: HEFZJCU01A3ME9.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaatgaacagcctgagagctgaggacacggctgtgtattactgtgcgaaagatttctatagaggtgactac

SEQ ID NO: 452528 - DNA, 493 bp, Homo sapiens
  misc_feature: HEFZJCU01CJCG3.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttcccctggccaccctcctccaagagcacctcgtgggggcacagcggccctgggctcgcctggtcaaggactacttcgtatctctcg

SEQ ID NO: 452529 - DNA, 496 bp, Homo sapiens
  misc_feature: HEFZJCU01CC4S0.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccgagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagagtttggggaatgaccacgtc

SEQ ID NO: 452530 - DNA, 385 bp, Homo sapiens; identical to SEQ ID NO: 444438
  misc_feature: HEFZJCU01ESJWW.18.60.F05.1.454.heavy.3.raw

SEQ ID NO: 452531 - DNA, 507 bp, Homo sapiens
  misc_feature: HEFZJCU01BMIIV.52.71.G05.1.454.heavy.3.raw
cgcagtacgacacgaccggtgctcgatttagtgtcgtcgcaagagagagggggagctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatggg

SEQ ID NO: 452532 - DNA, 406 bp, Homo sapiens
  misc_feature: HEFZJCU01AMR2X.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggcctgggctgcctggtcaaggactacttccgtatctctcg

SEQ ID NO: 452533 - DNA, 482 bp, Homo sapiens
  misc_feature: HEFZJCU01DU5XN.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagc

SEQ ID NO: 452534 - DNA, 534 bp, Homo sapiens
  misc_feature: HEFZJCU01CLQNP.51.49.E05.1.454.heavy.3.raw
cgatcgtatacacgaccggtgctcgatttagagcgactagcaacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagcccccgggaagggacttcagtggattggggaaatcagtcgtagtggagagaccttctacaaccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccc

SEQ ID NO: 452535 - DNA, 502 bp, Homo sapiens
  misc_feature: HEFZJCU01EGXYE.52.38.D05.1.454.heavy.3.raw
cgcagtacgacacgaccggtgctcgatttagtatctgatagttgggtttggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggcctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctattcttttactgtgcgagagggaactcgattacagcag

SEQ ID NO: 452536 - DNA, 509 bp, Homo sapiens; identical to SEQ ID NO: 446247
  misc_feature: HEFZJCU01CJK3P.51.43.D10.1.454.heavy.3.raw

SEQ ID NO: 452537 - DNA, 496 bp, Homo sapiens
  misc_feature: HEFZJCU01EKZHO.48.38.D05.1.454.heavy.3.raw
agtatacatacacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccgaggggggggctggagtgggtggccaatataaagggagagtggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatcct

SEQ ID NO: 452538 - DNA, 509 bp, Homo sapiens
  misc_feature: HEFZJCU01EOCSR.49.27.C05.1.454.heavy.3.raw
agtcgagagacacgaccggtgctcgatttagacgcgatcgaagggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagcacctctgggggcacagcggccctgggctgcctggtcaaggactacttcctctctcgactc

SEQ ID NO: 452539 - DNA, 482 bp, Homo sapiens; identical to SEQ ID NO: 444904
  misc_feature: HEFZJCU01A4CGO.47.59.F04.1.454.heavy.3.raw

SEQ ID NO: 452540 - DNA, 511 bp, Homo sapiens
  misc_feature: HEFZJCU01BL722.52.78.H01.1.454.heavy.3.raw
cgcagtacgacacgaccggtgctcgatttagtgtgagtagtttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaacgggcccagtcggtccttccccgtc

SEQ ID NO: 452541 - DNA, 530 bp, Homo sapiens
  misc_feature: HEFZJCU01EUHUN.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcacgcccccaggaaaggccctggagtggcttgcgctcatttattgggatgagagtaagcactacagtccgtctctgaagaacaggctcaccatcaccaaggacacctccaacaaaccaggtggtccttacaatgaccaatatggaccctgtggacacagccacatattactgttcacgctctatggttcggggagttattagtcccttactttgactacgtggggccaggggaactcgtggtcaccgtcctccgcagccctccaaccgaacgggcccacttcc

SEQ ID NO: 452542 - DNA, 521 bp, Homo sapiens
  misc_feature: HEFZJCU01D2ZRP.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctacggtgacaaatttattccaaaccagacaaagtttccg

SEQ ID NO: 452543 - DNA, 515 bp, Homo sapiens
  misc_feature: HEFZJCU01EL375.48.53.E09.1.454.heavy.3.raw
agtatacatacacgaccggtgctcgatttagagagagtgtgttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaaggactggaatggattgggagtatctattatacagggagcacctactacaacccgtccctcaagagtcgagtcaccatctccgcagacacgtaccaagaaccagttctccctgaggctgagctctgtgaccgccgcagacacggctgtctattactgtgcgagagtgggtcgtggcagtggctggtacgtggctctcagtggttcgacccgtggggccagggatacctggtctaccg

SEQ ID NO: 452544 - DNA, 376 bp, Homo sapiens
  misc_feature: HEFZJCU01AIKXL.49.41.D08.1.454.heavy.3.raw
agtcgagagacacgaccggtgctcgatttagtcacgcgagaaagggaaaggggctggagtgggtggccaacataaaccaagatggaactgtggaagactacatagactctgtgaagggccgattcaccatctccagagacagcgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgagagcacagcggccctgggctgcctggtcaaggactacttcctctctcgact

SEQ ID NO: 452545 - DNA, 506 bp, Homo sapiens
  misc_feature: HEFZJCU01C4D5R.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaaggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaaggcccatcggtcttcccctggcaccctcctccaagagcacctctgggggcacagcggccctgggctgcctggtcaaggactacttccgagtgcgtct

SEQ ID NO: 452546 - DNA, 411 bp, Homo sapiens
  misc_feature: HEFZJCU01BQVHQ.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacacttttatatctgcaactcaacagactgacacccgcggacacggccgtctactactgtgtgaaagaagacggaccgctggacgaggagccagaggagaatcactactttgactactggggccagggaagactggtcaccgtctcctccgcctccaccaagggcccatcggtcttccccctggcaccctcctccaagagcacctctggggcacagcggccctgggctgcctggtcaaggactacttcctcgtagcact

SEQ ID NO: 452547 - DNA, 491 bp, Homo sapiens
  misc_feature: HEFZJCU01DEBVG.4.57.F02.1.454.heavy.3.raw
  modified_base (447)..(447): a, c, t, g, unknown or other
agcactgtagcacgaccggtgctcgatttagctcgatatagttgggtttgggggaggcgtggtccagcctggggggtccctcgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttgaccagtggggccagggaaccctggtcaccgtctcctcagcttccaccaagggcccatcggtcttcccctggcgccctgctccaggagcacctctgggggcacngcggccctgggctgcctggtcaaggactacttccctacagtgct

SEQ ID NO: 452548 - DNA, 487 bp, Homo sapiens; identical to SEQ ID NO: 445077
  misc_feature: HEFZJCU01BJ1XO.47.85.H08.1.454.heavy.3.raw

SEQ ID NO: 452549 - DNA, 528 bp, Homo sapiens
  misc_feature: HEFZJCU01DPXYU.52.68.G02.1.454.heavy.3.raw
cgcagtacgacacgaccggtgctcgatttagtcgatagtgaagggaaaggggagctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaaggggctggaatgggtggcctttatttcatatgatggaaccaataaagcctacactgactccgtgaagggccgattcaccatctcccgagacaattccaagaacacactctatctgcaaatgaacagcctgagacatgaggacacggctgtttactcttgtgcgagaattgccctctttagggggccctttgacaactggggccagggaaccc

SEQ ID NO: 452550 - DNA, 480 bp, Homo sapiens
  misc_feature: HEFZJCU01CT14J.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggccctgggctgcctggtcaaggactacttctagagacacg

SEQ ID NO: 452551 - DNA, 522 bp, Homo sapiens
  misc_feature: HEFZJCU01DV9CG.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccg

SEQ ID NO: 452552 - DNA, 522 bp, Homo sapiens
  misc_feature: HEFZJCU01D5SFA.53.41.D08.1.454.heavy.3.raw
  modified_base (461)..(461): a, c, t, g, unknown or other
cgcgtatacacacgaccggtgctcgatttagtcacgcgagaaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgtagtctctggattcaccttcagggtctatgacatgcactgggtccgccaggctccaggcaaggggctggagtgggtggcagttatttcaaatgatggaagtaacaaatactatgtggactccgtgaagggccgattcaccatctccagagacaattccaagaatacgctgtatctgcacatgaacagcctgagagccgaagacacgggtntttattactgtgcgaacttaattacggaggacaacggtaaccccgtccgcacggtacgacg

SEQ ID NO: 452553 - DNA, 491 bp, Homo sapiens; identical to SEQ ID NO: 445531
  misc_feature: HEFZJCU01BTVUU.11.38.D05.1.454.heavy.3.raw

SEQ ID NO: 452554 - DNA, 518 bp, Homo sapiens; identical to SEQ ID NO: 448852
  misc_feature: HEFZJCU01A3G8Z.16.10.A10.1.454.heavy.3.raw

SEQ ID NO: 452555 - DNA, 352 bp, Homo sapiens
  misc_feature: HEFZJCU01BX6OB.49.4.A04.1.454.heavy.3.raw
agtcgagagacacgaccggtgctcgatttagagtagtgatcagggacattgactccgtgaagggccgattcatcatctccagagacaactccgagaacacactgtatcttcaaatgaacaggttgagagctgaagacacggctttatattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 452556 - DNA, 423 bp, Homo sapiens; identical to SEQ ID NO: 444772
  misc_feature: HEFZJCU01BP0O8.16.78.H01.1.454.heavy.3.raw

SEQ ID NO: 452557 - DNA, 316 bp, Homo sapiens; identical to SEQ ID NO: 444479
  misc_feature: HEFZJCU01DJEB9.47.84.H07.1.454.heavy.3.raw

SEQ ID NO: 452558 - DNA, 524 bp, Homo sapiens
  misc_feature: HEFZJCU01CVSN2.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagcgtggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgaagaacacggtgtatcttcaaatgaacaacctgagagccgacgacacggccgtttattactgtgcgagagtattcgagtggttcggggacctcaccctggttctacttcgatctctgggggcc

SEQ ID NO: 452559 - DNA, 543 bp, Homo sapiens
  misc_feature: HEFZJCU01CXHIK.48.5.A05.1.454.heavy.3.raw
agtatacatacacgaccggtgctcgatttagatagatagacaggggctgagagaggagcccagccctgggattttcaggtgttttcatttggtgatcaggactgaacagagagaactcaccatggagtttgggttgagctggctttttcttgtggctattttaaaaggtgtccagtgtgaggtccagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgaggggccggttcaccgtctccagagacaattccaagaacacgctatttctgacaaatgaacagcctgagtagtcgacgacgaccggaccgtatactactgtgcgaagacagatgctcgcccgccgttcgttccgggtcggggccgacgggacccgtggtccaccgtctcctcg

SEQ ID NO: 452560 - DNA, 467 bp, Homo sapiens
  misc_feature: HEFZJCU01DKKCP.49.10.A10.1.454.heavy.3.raw
agtcgagagacacgaccggtgctcgatttagcgtcgatctcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggccccccctttcaggagcgatcatactactttgaccactggggccagggaaccctggtcaccgtctcctcagcctccaccaagggcccatcggtcttccccctggcaccctcctccaagagcacctctggggcacagcggccctggctgcctggtcaaggactacttcctctctcgact

SEQ ID NO: 452561 - DNA, 541 bp, Homo sapiens
  misc_feature: HEFZJCU01A401E.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggagtcggggagtttggttccgtggggccagggaaccctggtc

SEQ ID NO: 452562 - DNA, 390 bp, Homo sapiens; identical to SEQ ID NO: 444541
  misc_feature: HEFZJCU01D41PY.16.24.C02.1.454.heavy.3.raw

SEQ ID NO: 452563 - DNA, 396 bp, Homo sapiens; identical to SEQ ID NO: 444469
  misc_feature: HEFZJCU01AFWYY.47.46.E02.1.454.heavy.3.raw

SEQ ID NO: 452564 - DNA, 541 bp, Homo sapiens
  misc_feature: HEFZJCU01CM4IN.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacactcccctgaaagcgtcaactactactactacggtatggacctctgggccaagggaccg

SEQ ID NO: 452565 - DNA, 509 bp, Homo sapiens; identical to SEQ ID NO: 444586
  misc_feature: HEFZJCU01AXE7T.12.78.H01.1.454.heavy.3.raw

SEQ ID NO: 452566 - DNA, 423 bp, Homo sapiens
  misc_feature: HEFZJCU01BZPOJ.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaaccgtggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 452567 - DNA, 514 bp, Homo sapiens
  misc_feature: HEFZJCU01AIKUW.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgattctctgggccgtggcaccctggtcactgtctcctcggcttccaccaagggcccatcggtcttcccctggcgccctgctccaggagcacctctgggggcacagcggcccg

SEQ ID NO: 452568 - DNA, 379 bp, Homo sapiens
  misc_feature: HEFZJCU01DEBCL.40.13.B02.1.454.heavy.3.raw
tctagcgactcacgaccggtgctcgatttagtctagcgactttggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttccagtcgctaga

SEQ ID NO: 452569 - DNA, 517 bp, Homo sapiens; identical to SEQ ID NO: 444897
  misc_feature: HEFZJCU01ANW57.9.34.D01.1.454.heavy.3.raw

SEQ ID NO: 452570 - DNA, 500 bp, Homo sapiens; identical to SEQ ID NO: 444529
  misc_feature: HEFZJCU01EIWVI.12.38.D05.1.454.heavy.3.raw

SEQ ID NO: 452571 - DNA, 499 bp, Homo sapiens; identical to SEQ ID NO: 447382
  misc_feature: HEFZJCU01BOPC1.11.73.G07.1.454.heavy.3.raw

SEQ ID NO: 452572 - DNA, 506 bp, Homo sapiens; identical to SEQ ID NO: 444696
  misc_feature: HEFZJCU01DPK3Q.16.34.D01.1.454.heavy.3.raw

SEQ ID NO: 452573 - DNA, 513 bp, Homo sapiens; identical to SEQ ID NO: 445134
  misc_feature: HEFZJCU01CARAP.3.34.D01.1.454.heavy.3.raw

SEQ ID NO: 452574 - DNA, 413 bp, Homo sapiens
  misc_feature: HEFZJCU01DSVB1.53.68.G02.1.454.heavy.3.raw
cgcgtatacacacgaccggtgctcgatttagtcgatagtgaagggaaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggacttggttctcccatggaatcccttactttgagtactggggccgcggagccctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 452575 - DNA, 545 bp, Homo sapiens
  misc_feature: HEFZJCU01AQ187.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattccaccgtctccagagacaacaccaagaacacactatatctgcagattgacagtctgacgacccgaggacacggctgtgtattactgtgcaaggcagttcgtaggaaactagtttagtggggttggggggtagttttggggtttttttttacgttacgttacggggt

SEQ ID NO: 452576 - DNA, 525 bp, Homo sapiens
  misc_feature: HEFZJCU01DY051.10.53.E09.1.454.heavy.3.raw
catagtagtgcacgaccggtgctcgatttagagagagtgtgttgggtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtcttcccctggcaccctcctccaagagcacctctgggggcacagcc

SEQ ID NO: 452577 - DNA, 522 bp, Homo sapiens
  misc_feature: HEFZJCU01CGORN.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctcccaagagcacctctgggggcacacg

SEQ ID NO: 452578 - DNA, 500 bp, Homo sapiens; identical to SEQ ID NO: 444529
  misc_feature: HEFZJCU01CINLF.12.38.D05.1.454.heavy.3.raw

SEQ ID NO: 452579 - DNA, 406 bp, Homo sapiens
  misc_feature: HEFZJCU01EPQNL.48.58.F03.1.454.heavy.3.raw
agtatacatacacgaccggtgctcgatttagtctgatcgagaagggaaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 452580 - DNA, 503 bp, Homo sapiens
  misc_feature: HEFZJCU01C70W6.12.79.H02.1.454.heavy.3.raw
  modified_base (500)..(500): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagctatccttttcttggtgacagtagcaacaggtgtccactcccaggtgcatctggagcagtctggagctgaggtgaaggagcctggggcctacagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagtaattaattttcgttattgttctggtgtgtgtgttcaatgttnacc

SEQ ID NO: 452581 - DNA, 491 bp, Homo sapiens
  misc_feature: HEFZJCU01BMVEC.51.81.H04.1.454.heavy.3.raw
cgatcgtatacacgaccggtgctcgatttagtagtgtagattcgcgggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcag

SEQ ID NO: 452582 - DNA, 460 bp, Homo sapiens
  misc_feature: HEFZJCU01DDF6H.40.23.C01.1.454.heavy.3.raw
tctagcgactcacgaccggtgctcgatttagtacacgtgattagggattgggggattcacttttggtgattatgccatgcactgggtccggcaagctccagggaagggcctggagtgggtctcaggtattagttggaatagtggaagtattgactatggggactctgtgaagggccgattcaccatctccagagacaacgccaagaactccctgtatctgcaaatgagcagtctgagagctgaggacacggccttgtattactgtgcaaagatactaggggaatagtagtgtctcggcggcttggtgcttttgatatctggggccaagggacaatggtcaccgtctcttcagcctccaccaagggcccatcggtcttcccctggcgccctgctccaggagcacctccgagagcacagcggccctgggctgcctggtcaaggactacttccagtcgctaga

SEQ ID NO: 452583 - DNA, 518 bp, Homo sapiens; identical to SEQ ID NO: 451556
  misc_feature: HEFZJCU01EI524.13.76.G10.1.454.heavy.3.raw

SEQ ID NO: 452584 - DNA, 519 bp, Homo sapiens
  misc_feature: HEFZJCU01BIOWA.2.11.A11.1.454.heavy.3.raw
acgctcgacacacgaccggtgctcgatttagctacgactgcagggtgtacacctgtggttctcggggctgccctttggctttggagatggttttctcgatggggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttccccctggcaccctcctccaagagcacctctgggggcacagcggccctgggctgcctggtcaggactacttcctgtcgagcgt

SEQ ID NO: 452585 - DNA, 489 bp, Homo sapiens
  misc_feature: HEFZJCU01DZ6OI.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctcggcgccctgctccaggagcacctccgagagcacagcggccctgggctgcctggtcaaggactactcccatactcgta

SEQ ID NO: 452586 - DNA, 509 bp, Homo sapiens
  misc_feature: HEFZJCU01BOLGW.15.1.A01.1.454.heavy.3.raw
tctacgtagccacgaccggtgctcgatttagacgtctcatcagggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttcccctggcaccctcctccaagagcacctctgggggcacagcggccctgggctgcctggtcaaggactacttccgctacgt

SEQ ID NO: 452587 - DNA, 506 bp, Homo sapiens
  misc_feature: HEFZJCU01EGOUR.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctgggctgcctggtcaggactacttccgagtagtaca

SEQ ID NO: 452588 - DNA, 403 bp, Homo sapiens; identical to SEQ ID NO: 444540
  misc_feature: HEFZJCU01AQJV0.16.72.G06.1.454.heavy.3.raw

SEQ ID NO: 452589 - DNA, 482 bp, Homo sapiens; identical to SEQ ID NO: 444503
  misc_feature: HEFZJCU01D6IN0.7.10.A10.1.454.heavy.3.raw

SEQ ID NO: 452590 - DNA, 530 bp, Homo sapiens
  misc_feature: HEFZJCU01CAURD.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtgcgagagcgtcgtctgtcagtggaattgactactggggccagggaaccctggtcaccgtctcctcacgcctccaccaac

SEQ ID NO: 452591 - DNA, 488 bp, Homo sapiens; identical to SEQ ID NO: 444617
  misc_feature: HEFZJCU01DN6D6.4.6.A06.1.454.heavy.3.raw

SEQ ID NO: 452592 - DNA, 483 bp, Homo sapiens; identical to SEQ ID NO: 444639
  misc_feature: HEFZJCU01BV2JS.11.23.C01.1.454.heavy.3.raw

SEQ ID NO: 452593 - DNA, 512 bp, Homo sapiens
  misc_feature: HEFZJCU01DY72H.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccagggaactctggtcacgtctccgcagcctccaccaaggccc

SEQ ID NO: 452594 - DNA, 483 bp, Homo sapiens
  misc_feature: HEFZJCU01CP93X.11.63.F08.1.454.heavy.3.raw
cgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttggagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgttgcgagagataaagggggattgtgatacg

SEQ ID NO: 452595 - DNA, 513 bp, Homo sapiens
  misc_feature: HEFZJCU01A1JSB.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgagttcaccatctccagagacttttctcagaacacactgtctcttcaaatgaacagcctgagggccgaggacacggccgtctattattgtgtgagagtttatggcgatggctggtggacagatcactggggcca

SEQ ID NO: 452596 - DNA, 515 bp, Homo sapiens
  misc_feature: HEFZJCU01CWRBQ.48.22.B11.1.454.heavy.3.raw
agtatacatacacgaccggtgctcgatttagacgacagctcaggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccatttattttgtgctagatctgaagaattaccagctgctgtgttctccccc

SEQ ID NO: 452597 - DNA, 412 bp, Homo sapiens; identical to SEQ ID NO: 444705
  misc_feature: HEFZJCU01ECKPI.51.60.F05.1.454.heavy.3.raw

SEQ ID NO: 452598 - DNA, 499 bp, Homo sapiens
  misc_feature: HEFZJCU01C3YJN.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaagggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgat

SEQ ID NO: 452599 - DNA, 372 bp, Homo sapiens; identical to SEQ ID NO: 450118
  misc_feature: HEFZJCU01C8P2P.12.86.H09.1.454.heavy.3.raw

SEQ ID NO: 452600 - DNA, 517 bp, Homo sapiens
  misc_feature: HEFZJCU01C99WY.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcgcctgggctgcctggtcaaggactacttccagacgtatca

SEQ ID NO: 452601 - DNA, 400 bp, Homo sapiens; identical to SEQ ID NO: 444452
  misc_feature: HEFZJCU01EBLXO.47.24.C02.1.454.heavy.3.raw

SEQ ID NO: 452602 - DNA, 510 bp, Homo sapiens; identical to SEQ ID NO: 446874
  misc_feature: HEFZJCU01BA4AS.18.39.D06.1.454.heavy.3.raw

SEQ ID NO: 452603 - DNA, 497 bp, Homo sapiens; identical to SEQ ID NO: 447711
  misc_feature: HEFZJCU01BTPR4.16.37.D04.1.454.heavy.3.raw

SEQ ID NO: 452604 - DNA, 507 bp, Homo sapiens; identical to SEQ ID NO: 446637
  misc_feature: HEFZJCU01C5JPJ.16.34.D01.1.454.heavy.3.raw

SEQ ID NO: 452605 - DNA, 482 bp, Homo sapiens; identical to SEQ ID NO: 451792
  misc_feature: HEFZJCU01EX0M5.19.71.G05.1.454.heavy.3.raw

SEQ ID NO: 452606 - DNA, 493 bp, Homo sapiens
  misc_feature: HEFZJCU01APVZB.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtggtttcgtcgtaggctctttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggaacacggctgtgtattactgtgggagagatggaggtcgatattgta

SEQ ID NO: 452607 - DNA, 500 bp, Homo sapiens; identical to SEQ ID NO: 445720
  misc_feature: HEFZJCU01A6I3G.3.20.B09.1.454.heavy.3.raw

SEQ ID NO: 452608 - DNA, 500 bp, Homo sapiens
  misc_feature: HEFZJCU01CDDKZ.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggtggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 452609 - DNA, 375 bp, Homo sapiens
  misc_feature: HEFZJCU01C5KNB.48.23.C01.1.454.heavy.3.raw
agtatacatacacgaccggtgctcgatttagtacacgtgattagggagttgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctggggcacagcggccctgggctgcctggtcaaggactacttcctatgtatact

SEQ ID NO: 452610 - DNA, 506 bp, Homo sapiens
  misc_feature: HEFZJCU01EQR7T.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctcggcaccctcctccaagagcacctctgggggcacagcggccctgggctgcctggtcaaggactacttcctacgtcgtat

SEQ ID NO: 452611 - DNA, 502 bp, Homo sapiens; identical to SEQ ID NO: 445414
  misc_feature: HEFZJCU01AFXH7.17.25.C03.1.454.heavy.3.raw

SEQ ID NO: 452612 - DNA, 513 bp, Homo sapiens
  misc_feature: HEFZJCU01EDSU5.4.30.C08.1.454.heavy.3.raw
agcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtctgggggaggcttggtccagcctggggggtccctgagactctcctgtgcagcctctggattcacctttactacctattggatggactgggtccgccaggctccagggaagggctggagtgggtggccaacataaaccaagatggaagtgaacagtactatgtggactctgtgaagggccgattcaccatctccagagacaacgccaagaactcactgtatctgcaaatgaacagcctgagagccgaggacacggctattttattactgtgtagaaagagaactggttcttcgatctctggggccgtgcc

SEQ ID NO: 452613 - DNA, 510 bp, Homo sapiens
  misc_feature: HEFZJCU01BC0RI.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggtacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttgactactggggccac

SEQ ID NO: 452614 - DNA, 491 bp, Homo sapiens; identical to SEQ ID NO: 446104
  misc_feature: HEFZJCU01CVT8G.3.34.D01.1.454.heavy.3.raw

SEQ ID NO: 452615 - DNA, 504 bp, Homo sapiens
  misc_feature: HEFZJCU01AR7J7.40.81.H04.1.454.heavy.3.raw
  modified_base (465)..(465): a, c, t, g, unknown or other
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtgacgacacggccatgtattactgtggaanagacgttggtggctaccgcggggctgaccactggggccg

SEQ ID NO: 452616 - DNA, 484 bp, Homo sapiens
  misc_feature: HEFZJCU01EG7U1.40.71.G05.1.454.heavy.3.raw
tctagcgactcacgaccggtgctcgatttagtgtcgtcgcaagagagagggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagcctgacatctgacgacacggccgtatattactgtgcgagagatcatcgggaggtggaatgccgtgt

SEQ ID NO: 452617 - DNA, 497 bp, Homo sapiens; identical to SEQ ID NO: 446430
  misc_feature: HEFZJCU01CVD1J.51.78.H01.1.454.heavy.3.raw

SEQ ID NO: 452618 - DNA, 497 bp, Homo sapiens
  misc_feature: HEFZJCU01CRXR6.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagctccgtgaagggccgattcaccgtctccagagacaattccaggcacacgctgtatctgcaaatgaacagcctgagagctgaggacacggctgtgtattactgtgcgaaagatttctatagaggtgactac

SEQ ID NO: 452619 - DNA, 489 bp, Homo sapiens
  misc_feature: HEFZJCU01D6IZI.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcaccctcctccaagagcacctctgggggcacagcggccctgggctgcctggtcaaggactacttcctacgtgagct

SEQ ID NO: 452620 - DNA, 528 bp, Homo sapiens; identical to SEQ ID NO: 446119
  misc_feature: HEFZJCU01AJZGB.14.35.D02.1.454.heavy.3.raw

SEQ ID NO: 452621 - DNA, 517 bp, Homo sapiens
  misc_feature: HEFZJCU01CGL0M.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactgggggccggggaaccctggtcgccgtctcctcagcctccaccaagggcccatcgtcttcccctggcaccctcctccaagagcacctctgggggcacagcggccctgggctgcctggtcaaggactacttccagacgtatca

SEQ ID NO: 452622 - DNA, 505 bp, Homo sapiens; identical to SEQ ID NO: 452168
  misc_feature: HEFZJCU01APG3Q.48.29.C07.1.454.heavy.3.raw

SEQ ID NO: 452623 - DNA, 532 bp, Homo sapiens
  misc_feature: HEFZJCU01A6LXQ.52.27.C05.1.454.heavy.3.raw
cgcagtacgacacgaccggtgctcgatttagacgcgatcgaagggtttggggggacctcctgtgcaagaacatgaagcacctgtggttcttcctcctgctggtggcggctcccagatgggtcctgtcccagctgcagctgcaagagtcgggcccacgactggtgaagcctgcggagcccctgtccctcacctgcactgtctctggtgactccatcaccaataatgattactactgggcctggatccgccagcccccagggaaggggctggagtggattggcagtatattttatactggaaatacctaccaaaacccgtccctcaacagccgactcaccatttcagtggacacgtccaagaaccagttctccctgaaactgagctctgtgaccgccgcagacacggccatttattactgtgcgggagagaggcacaagactggagttcccgggagctggttcggctcctggggccaggggacccggtcaccgtctcctcagcctccaccaagggcccatcggtcttcccctgg

SEQ ID NO: 452624 - DNA, 518 bp, Homo sapiens
  misc_feature: HEFZJCU01CUHCZ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggtcggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 452625 - DNA, 493 bp, Homo sapiens
  misc_feature: HEFZJCU01C7H58.51.30.C08.1.454.heavy.3.raw
cgatcgtatacacgaccggtgctcgatttagtctgacgtcaaagggaaagggggggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggagtgggtggcacttatctcatctgatggaaggtctgaatcttatgccgactccgtgaagggccgattcaccatctccagagacaattccaagaatacactatatcttcaaatgaacagtctgagacgtgaagacacggctgtctattactgtgcgactgagatgtcttattacg

SEQ ID NO: 452626 - DNA, 510 bp, Homo sapiens
  misc_feature: HEFZJCU01D7QBL.48.33.C11.1.454.heavy.3.raw
agtatacatacacgaccggtgctcgatttagagtgagctcgttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccaagggatcacggtcaccgtctcctcagcctccaccaacgggcccatcggtcttcccctggcaccctcctccaagagcacctctc

SEQ ID NO: 452627 - DNA, 502 bp, Homo sapiens
  misc_feature: HEFZJCU01ER9GO.48.78.H01.1.454.heavy.3.raw
agtatacatacacgaccggtgctcgatttagtgtgagtagtttgggtttgggggctctgggagaggagccccagccctgagattcccaggtgtttccattcagtgatcagcactgaacacagaggactcaccatggagttgggactgagctggattttccttttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcatagactaacg

SEQ ID NO: 452628 - DNA, 512 bp, Homo sapiens; identical to SEQ ID NO: 445688
  misc_feature: HEFZJCU01DCZ5U.3.34.D01.1.454.heavy.3.raw

SEQ ID NO: 452629 - DNA, 506 bp, Homo sapiens; identical to SEQ ID NO: 445682
  misc_feature: HEFZJCU01AOPAZ.48.44.D11.1.454.heavy.3.raw

SEQ ID NO: 452630 - DNA, 477 bp, Homo sapiens
  misc_feature: HEFZJCU01BV1XS.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctgaagacacggctgtgtttactgtgcgagagaga

SEQ ID NO: 452631 - DNA, 494 bp, Homo sapiens
  misc_feature: HEFZJCU01BP4M3.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctggctgcctggtcaaggactacttccctacagtgct

SEQ ID NO: 452632 - DNA, 355 bp, Homo sapiens; identical to SEQ ID NO: 444443
  misc_feature: HEFZJCU01B59QV.47.38.D05.1.454.heavy.3.raw

SEQ ID NO: 452633 - DNA, 495 bp, Homo sapiens
  misc_feature: HEFZJCU01ERZIP.52.86.H09.1.454.heavy.3.raw
cgcagtacgacacgaccggtgctcgatttagtgctatagacttgggtttgggggaggcttggtccagcctggtggttccctgagactctcctgtgcagcctctggattctccgtcagtagcaactacatgagctgggtccgccaggctccagggaaggggctggagtgggtctcaagtcttttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 452634 - DNA, 505 bp, Homo sapiens; identical to SEQ ID NO: 447076
  misc_feature: HEFZJCU01BVD1Q.10.38.D05.1.454.heavy.3.raw

SEQ ID NO: 452635 - DNA, 505 bp, Homo sapiens; identical to SEQ ID NO: 446616
  misc_feature: HEFZJCU01A1DBM.51.65.F10.1.454.heavy.3.raw

SEQ ID NO: 452636 - DNA, 523 bp, Homo sapiens
  misc_feature: HEFZJCU01AMGLY.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttccccctggcgccctcgctcccaggagcacctccgacgagcacagcgccctgggctgcctggtcaggactacttcctacg

SEQ ID NO: 452637 - DNA, 412 bp, Homo sapiens
  misc_feature: HEFZJCU01BOE1I.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgactgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 452638 - DNA, 492 bp, Homo sapiens; identical to SEQ ID NO: 444695
  misc_feature: HEFZJCU01BPQ6Q.3.34.D01.1.454.heavy.3.raw

SEQ ID NO: 452639 - DNA, 505 bp, Homo sapiens
  misc_feature: HEFZJCU01D81XR.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgacttcgtc

SEQ ID NO: 452640 - DNA, 501 bp, Homo sapiens
  misc_feature: HEFZJCU01EMW3N.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggcgtctattactgtgcgagagtcccacgatccggtgagccctacggcagcggcctttgacttc

SEQ ID NO: 452641 - DNA, 536 bp, Homo sapiens
  misc_feature: HEFZJCU01BZNK5.16.9.A09.1.454.heavy.3.raw
  modified_base (429)..(429): a, c, t, g, unknown or other
tgtactactccacgaccggtgctcgatttagcgagacgcgcagggggagagaggggcccagccctgggattttcaggtgttttcatttggtgatcaggactgaacagagagaactcaccatggagtttgggctgagctggcttttcttgtggctattttaaaaggtgtccagtgtgaggtgcagttggtgggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagaggacaattccaagacacgctctatctgcaattgaccngcctgagcgccgaggacacggccatgtattactgtactaaatcgtcgggtggtccgcggccggtaccgtcggactggttttgagttttctggggtccaaggggaacg

SEQ ID NO: 452642 - DNA, 378 bp, Homo sapiens
  misc_feature: HEFZJCU01AG2VI.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctccgacagcacagcggccctgggctgcctggtcaaggactacttcctacgtgagct

SEQ ID NO: 452643 - DNA, 487 bp, Homo sapiens
  misc_feature: HEFZJCU01BQEQA.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaaggactactccctacagtgct

SEQ ID NO: 452644 - DNA, 492 bp, Homo sapiens
  misc_feature: HEFZJCU01BMLB4.53.62.F07.1.454.heavy.3.raw
cgcgtatacacacgaccggtgctcgatttagtagtcgcataaagggaaagggtgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacgaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaaggactacttcctcgtactgcg

SEQ ID NO: 452645 - DNA, 519 bp, Homo sapiens; identical to SEQ ID NO: 449382
  misc_feature: HEFZJCU01DA3AG.16.10.A10.1.454.heavy.3.raw

SEQ ID NO: 452646 - DNA, 489 bp, Homo sapiens; identical to SEQ ID NO: 444791
  misc_feature: HEFZJCU01B79X0.47.85.H08.1.454.heavy.3.raw

SEQ ID NO: 452647 - DNA, 436 bp, Homo sapiens; identical to SEQ ID NO: 447936
  misc_feature: HEFZJCU01CH8A0.3.21.B10.1.454.heavy.3.raw

SEQ ID NO: 452648 - DNA, 381 bp, Homo sapiens; identical to SEQ ID NO: 445431
  misc_feature: HEFZJCU01ESL9I.3.70.G04.1.454.heavy.3.raw

SEQ ID NO: 452649 - DNA, 520 bp, Homo sapiens
  misc_feature: HEFZJCU01EPYL3.13.71.G05.1.454.heavy.3.raw
tcacgtactacacgaccggtgctcgatttagtgtcgtcgcaagagagaggggggggtcaaccgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcaaaatacgcatactacggtaattcaccggcttactactacaacggtatggacgtctggggccaagggaccacggtcaccgtctcctcagcctccaccaaggcccatcggtcttccccctggca

SEQ ID NO: 452650 - DNA, 400 bp, Homo sapiens; identical to SEQ ID NO: 444452
  misc_feature: HEFZJCU01CWGTZ.47.24.C02.1.454.heavy.3.raw

SEQ ID NO: 452651 - DNA, 536 bp, Homo sapiens
  misc_feature: HEFZJCU01CFTP9.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccgagggaaccctggtcaccgtctcctcagcctccaccaagggcccatcggtcttcccctggccaccctcctccaagagcacctcgtcgggggcacgagcggccctgggctgcctc

SEQ ID NO: 452652 - DNA, 508 bp, Homo sapiens; identical to SEQ ID NO: 450989
  misc_feature: HEFZJCU01BY20W.12.27.C05.1.454.heavy.3.raw

SEQ ID NO: 452653 - DNA, 465 bp, Homo sapiens; identical to SEQ ID NO: 444805
  misc_feature: HEFZJCU01CLWQ3.19.10.A10.1.454.heavy.3.raw

SEQ ID NO: 452654 - DNA, 533 bp, Homo sapiens
  misc_feature: HEFZJCU01DSS8G.48.63.F08.1.454.heavy.3.raw
agtatacatacacgaccggtgctcgatttagcgatcgtataaggggtctgggagaggagccccagccgtgagattcccaggagtttccacttggtgctcagcactgaacacagaccaccaaccatggagttagggcttagctggcttttccttgttgctattttaaagggtatccgatgtgaagtgcagatggtggagtctgggggagggttggttcagccagggcggtccctgagactctcctgcacaacttctggattccccttttctgattatactatccactgggtccgccaggcgcccgggaaggggctggagtgggtaggtttcgttagcaagaaaccttatggtggtccaccggaatacgccgcgtctgtgaaaggcagattcatcatctcaagagaggattccaagaacaccgcctatctgcaatgaacagcctgaaaatcgacgacacagccatttattactgtactagagcctattcgtacattggtgtactcccttctcgtaatgcctttaatatgtgggcc

SEQ ID NO: 452655 - DNA, 395 bp, Homo sapiens; identical to SEQ ID NO: 447960
  misc_feature: HEFZJCU01AQ7UI.10.42.D09.1.454.heavy.3.raw

SEQ ID NO: 452656 - DNA, 502 bp, Homo sapiens
  misc_feature: HEFZJCU01DK0D4.4.58.F03.1.454.heavy.3.raw
  modified_base (429)..(429): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaanacacggctgtgtattactgttcgagacgggctagtctgggatctagttatagtgactcgtcgttctggggccg

SEQ ID NO: 452657 - DNA, 516 bp, Homo sapiens
  misc_feature: HEFZJCU01A0JLJ.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccagggcccatcggtcttcccctggcgccctgctccaggagcacctccgaggagcacagcggccctcgggctcg

SEQ ID NO: 452658 - DNA, 499 bp, Homo sapiens; identical to SEQ ID NO: 446805
  misc_feature: HEFZJCU01EL2CY.3.20.B09.1.454.heavy.3.raw

SEQ ID NO: 452659 - DNA, 514 bp, Homo sapiens
  misc_feature: HEFZJCU01DR96E.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgaccacggccatatattactgtgacgaaagcaccggcagttagtcacccatactactttgactactggggccaac

SEQ ID NO: 452660 - DNA, 415 bp, Homo sapiens; identical to SEQ ID NO: 444794
  misc_feature: HEFZJCU01EUAEM.14.74.G08.1.454.heavy.3.raw

SEQ ID NO: 452661 - DNA, 508 bp, Homo sapiens
  misc_feature: HEFZJCU01BQHTB.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatccggtcttcccctggcgccctgctccaggacg

SEQ ID NO: 452662 - DNA, 512 bp, Homo sapiens
  misc_feature: HEFZJCU01C3U7C.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccgttcaccatctccagagacaattccaagaacacactgtatctgcaaatgaacagcctgagagccgacgacacggccatatattacctgtgcgaaagcaccggcagttagtcacccatactactttgactactggggccg

SEQ ID NO: 452663 - DNA, 547 bp, Homo sapiens
  misc_feature: HEFZJCU01AD3IZ.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctgggggcccaggggacaatc

SEQ ID NO: 452664 - DNA, 518 bp, Homo sapiens
  misc_feature: HEFZJCU01BAA2F.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagcgtgggttttccgttgttagctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggaccg

SEQ ID NO: 452665 - DNA, 482 bp, Homo sapiens
  misc_feature: HEFZJCU01C3HAW.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctctccaagagcacctctgggggcacagcggccctgggctgcctggtcaaggactacttccgtatctctcg

SEQ ID NO: 452666 - DNA, 420 bp, Homo sapiens
  misc_feature: HEFZJCU01DLSRP.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggcctggctgcctggtcaaggactacttccgagtagtaca

SEQ ID NO: 452667 - DNA, 513 bp, Homo sapiens
  misc_feature: HEFZJCU01EWDKE.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggcccatcggtcttccccctcgg

SEQ ID NO: 452668 - DNA, 376 bp, Homo sapiens
  misc_feature: HEFZJCU01CLT0T.49.42.D09.1.454.heavy.3.raw
agtcgagagacacgaccggtgctcgatttagacacatacgcagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgacgagcacagcggccctgggctgcctggtcaaggactacttcctctctcgact

SEQ ID NO: 452669 - DNA, 477 bp, Homo sapiens
  misc_feature: HEFZJCU01C9HUL.51.76.G10.1.454.heavy.3.raw
cgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctgggagtgggtggcatttatatcagatgatggcagtaataaagagtatgcagtctccgtgaagggccgattcaccatctccagagacaattcccagaacacactgtatctgcaaatgaacagattgagagctgaggacacggctgtgtatttctgtgcgaaacgctat

SEQ ID NO: 452670 - DNA, 501 bp, Homo sapiens; identical to SEQ ID NO: 447719
  misc_feature: HEFZJCU01BHH6A.17.10.A10.1.454.heavy.3.raw

SEQ ID NO: 452671 - DNA, 488 bp, Homo sapiens
  misc_feature: HEFZJCU01CQM6P.40.22.B11.1.454.heavy.3.raw
tctagcgactcacgaccggtgctcgatttagacgacagctcaggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctact

SEQ ID NO: 452672 - DNA, 403 bp, Homo sapiens
  misc_feature: HEFZJCU01EF0PE.51.41.D08.1.454.heavy.3.raw
cgatcgtatacacgaccggtgctcgatttagtcacgcgagaaagggaaaggggctggagtgggtggcacttatctcatctgatggaaggtctgaatcttatgccgactccgtgaagggccgattcaccatctccagagacaattccaagaatacactatatcttcaaatgaacagtctgagacgtgaagacacggctgtctattactgtgcgactgagatgtcttattacgatgccagtggtttagtaccgttcgacccctggggccagggaaccctggtcaccgtctcctcagcttccaccaagggcccatcggtcttccccctggcgccctgctccaggagcacctctgggggcacagcggccctgggctgcctggtcaaggactacttcctcgtagcact

SEQ ID NO: 452673 - DNA, 508 bp, Homo sapiens
  misc_feature: HEFZJCU01CZG2Z.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccggtgaagggccgattcaccatctccagagacaattccaagaacacgatgtatctgcaaatggacagcctaagagttgaggacacggctgtttattactgtacgaaagaggggggatacgagtggcagctccaagtactta

SEQ ID NO: 452674 - DNA, 324 bp, Homo sapiens; identical to SEQ ID NO: 444475
  misc_feature: HEFZJCU01CX0ZW.18.17.B06.1.454.heavy.3.raw

SEQ ID NO: 452675 - DNA, 522 bp, Homo sapiens
  misc_feature: HEFZJCU01DXTL4.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaaggcccatcggtcttcccctggcaccctcctccagagcacctc

SEQ ID NO: 452676 - DNA, 514 bp, Homo sapiens; identical to SEQ ID NO: 447992
  misc_feature: HEFZJCU01CD36C.48.19.B08.1.454.heavy.3.raw

SEQ ID NO: 452677 - DNA, 489 bp, Homo sapiens
  misc_feature: HEFZJCU01AO1JZ.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactgggccagggaaccctggtcaccgtctcctcagcctccaccaagggcccatcggtcttcccctggcgcctgctccaggagcacctccgagagcacagcggccctgggctgcctggtcaaggactacttcccacgagagta

SEQ ID NO: 452678 - DNA, 379 bp, Homo sapiens; identical to SEQ ID NO: 444450
  misc_feature: HEFZJCU01AHVFK.47.77.G11.1.454.heavy.3.raw

SEQ ID NO: 452679 - DNA, 521 bp, Homo sapiens
  misc_feature: HEFZJCU01CJOMK.49.81.H04.1.454.heavy.3.raw
  modified_base (497)..(497): a, c, t, g, unknown or other
agtcgagagacacgaccggtgctcgatttagtagtgtagattcgcggggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcaacggaggacaagggtnacccccgtcactcggtacggtacg

SEQ ID NO: 452680 - DNA, 496 bp, Homo sapiens; identical to SEQ ID NO: 445541
  misc_feature: HEFZJCU01BS2T0.53.25.C03.1.454.heavy.3.raw

SEQ ID NO: 452681 - DNA, 505 bp, Homo sapiens
  misc_feature: HEFZJCU01CHTUR.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctgcgcctgctccaggacg

SEQ ID NO: 452682 - DNA, 533 bp, Homo sapiens
  misc_feature: HEFZJCU01CNMK1.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaattggaggggcctttcatgtctgggccaagggacgctggtcaccgtctcttcagcctccaccaagggcccatcggtctcccctggcaccctcctccaagagcacctctgggggcacagcc

SEQ ID NO: 452683 - DNA, 507 bp, Homo sapiens
  misc_feature: HEFZJCU01CE2RK.10.5.A05.1.454.heavy.3.raw
catagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatgcccggggaaggcctggagtggatggggatcatcaatcttggtagctctgaaaccagatacaccccgtccttccaaggccgggtcaccatctcagccgacaggtccatcagtactacctacttggagtggattagcctgaaggcctcggacaccgccatgtattactgtacgagacttgaacggggattctattatggcgcgatctggggccagggaaccctggtcaccg

SEQ ID NO: 452684 - DNA, 501 bp, Homo sapiens; identical to SEQ ID NO: 445999
  misc_feature: HEFZJCU01BPHB9.12.38.D05.1.454.heavy.3.raw

SEQ ID NO: 452685 - DNA, 519 bp, Homo sapiens
  misc_feature: HEFZJCU01DB2PB.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgatgggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 452686 - DNA, 507 bp, Homo sapiens
  misc_feature: HEFZJCU01DHUBD.52.61.F06.1.454.heavy.3.raw
cgcagtacgacacgaccggtgctcgatttagctacgctctaagggaaaggggctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgcctggctcccggcaagggtctggactgggtggcaggtatatcagatgatgggaccaaaaatactacgcaaactccgtgaagggccgattcaccgtatctagagacagttccgatgacacaatctatctgcaaatgaacagcctgaaagttgacgacacgggtctttttactgtgcgcctgggagcagtggctggccacatgatgcttttg

SEQ ID NO: 452687 - DNA, 487 bp, Homo sapiens; identical to SEQ ID NO: 445077
  misc_feature: HEFZJCU01DERY8.47.85.H08.1.454.heavy.3.raw

SEQ ID NO: 452688 - DNA, 493 bp, Homo sapiens; identical to SEQ ID NO: 446596
  misc_feature: HEFZJCU01ECQ79.19.1.A01.1.454.heavy.3.raw

SEQ ID NO: 452689 - DNA, 489 bp, Homo sapiens
  misc_feature: HEFZJCU01CWA68.49.17.B06.1.454.heavy.3.raw
agtcgagagacacgaccggtgctcgatttagtcgatagtgaagggggctctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttactgtgcgccaggaagcagtggctc

SEQ ID NO: 452690 - DNA, 495 bp, Homo sapiens; identical to SEQ ID NO: 445359
  misc_feature: HEFZJCU01ALS6D.4.21.B10.1.454.heavy.3.raw

SEQ ID NO: 452691 - DNA, 506 bp, Homo sapiens; identical to SEQ ID NO: 444696
  misc_feature: HEFZJCU01EL4OI.16.34.D01.1.454.heavy.3.raw

SEQ ID NO: 452692 - DNA, 510 bp, Homo sapiens
  misc_feature: HEFZJCU01BXKOO.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggggccagggaaccctgggtcaccgtctcctcagcctccaccaagggcccatcggtcttcccctggcgccctgctccaggagcacctccgagagcacagcggccctgggctgcctggtcaaggactacttccagacgtatca

SEQ ID NO: 452693 - DNA, 506 bp, Homo sapiens
  misc_feature: HEFZJCU01AELUK.53.30.C08.1.454.heavy.3.raw
cgcgtatacacacgaccggtgctcgatttagtctgacgtcaaagggaaaggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatctttttactgttgcgagagggaactcgattacagcagccctcg

SEQ ID NO: 452694 - DNA, 314 bp, Homo sapiens; identical to SEQ ID NO: 444774
  misc_feature: HEFZJCU01DCTBQ.7.10.A10.1.454.heavy.3.raw

SEQ ID NO: 452695 - DNA, 524 bp, Homo sapiens; identical to SEQ ID NO: 445902
  misc_feature: HEFZJCU01C0T5F.9.78.H01.1.454.heavy.3.raw

SEQ ID NO: 452696 - DNA, 508 bp, Homo sapiens
  misc_feature: HEFZJCU01CV05I.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaagagcacctctgggggcacagcggccctgggctgcctggtcaaggactacttccgagtgcgtct

SEQ ID NO: 452697 - DNA, 481 bp, Homo sapiens; identical to SEQ ID NO: 445006
  misc_feature: HEFZJCU01CMO7Q.7.10.A10.1.454.heavy.3.raw

SEQ ID NO: 452698 - DNA, 379 bp, Homo sapiens; identical to SEQ ID NO: 444773
  misc_feature: HEFZJCU01EMKTG.3.59.F04.1.454.heavy.3.raw

SEQ ID NO: 452699 - DNA, 480 bp, Homo sapiens
  misc_feature: HEFZJCU01EM3HV.49.8.A08.1.454.heavy.3.raw
agtcgagagacacgaccggtgctcgatttagcatactctacaggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttaa

SEQ ID NO: 452700 - DNA, 465 bp, Homo sapiens; identical to SEQ ID NO: 445921
  misc_feature: HEFZJCU01BKIB2.48.34.D01.1.454.heavy.3.raw

SEQ ID NO: 452701 - DNA, 534 bp, Homo sapiens
  misc_feature: HEFZJCU01DJUM1.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttatggggccagggagccctggtcaccg

SEQ ID NO: 452702 - DNA, 513 bp, Homo sapiens
  misc_feature: HEFZJCU01CMLCG.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatacgtggggccagggaaccctggtccgtccg

SEQ ID NO: 452703 - DNA, 400 bp, Homo sapiens; identical to SEQ ID NO: 444452
  misc_feature: HEFZJCU01DZ7WF.47.24.C02.1.454.heavy.3.raw

SEQ ID NO: 452704 - DNA, 515 bp, Homo sapiens
  misc_feature: HEFZJCU01COID7.52.28.C06.1.454.heavy.3.raw
cgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccgatgaccagcgacaggtccactaacacagcctacatggagctaagtagactgacatctgacgacacggccgtctattattgtgtgagagaggacccgatgacctcgaacatggacgtctggggccgg

SEQ ID NO: 452705 - DNA, 359 bp, Homo sapiens
  misc_feature: HEFZJCU01BM4W5.40.41.D08.1.454.heavy.3.raw
tctagcgactcacgaccggtgctcgatttagtcacgcgagaaagggaaaggggggagcaccaactacaacccctccctcaagagtcgagtcaccatatcagtagacacgtccaagaaccagttctccctgaagctgagctctgtgaccgctgcggacacggccgtgtattactgtgcgagagggctgggattactatggttcggggagttattagtctggggccagggaaccctggtcaccgtctcctcagcttccaccaagggcccatcggtcttccccctggcgccctgctccaggagcacctctggggcacagcggccctgggctgcctggtcaaggactacttccagtcgctaga

SEQ ID NO: 452706 - DNA, 495 bp, Homo sapiens; identical to SEQ ID NO: 445611
  misc_feature: HEFZJCU01CBSHX.53.25.C03.1.454.heavy.3.raw

SEQ ID NO: 452707 - DNA, 519 bp, Homo sapiens
  misc_feature: HEFZJCU01EHTPE.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggactgtgtattactgtgtgagagatgttctgcgttggggccagggaaccctggtctaccg

SEQ ID NO: 452708 - DNA, 508 bp, Homo sapiens; identical to SEQ ID NO: 445594
  misc_feature: HEFZJCU01A479V.17.25.C03.1.454.heavy.3.raw

SEQ ID NO: 452709 - DNA, 519 bp, Homo sapiens
  misc_feature: HEFZJCU01DQ2PE.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctc

SEQ ID NO: 452710 - DNA, 510 bp, Homo sapiens
  misc_feature: HEFZJCU01EP27M.48.12.B01.1.454.heavy.3.raw
agtatacatacacgaccggtgctcgatttagtagtgtagattccgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgtaa

SEQ ID NO: 452711 - DNA, 498 bp, Homo sapiens
  misc_feature: HEFZJCU01AF3J3.53.53.E09.1.454.heavy.3.raw
cgcgtatacacacgaccggtgctcgatttagagagagtgtgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctgggccagggaaccctggtcaccgtctcctcagcttccaccaacggcccatcggtcttcccc

SEQ ID NO: 452712 - DNA, 499 bp, Homo sapiens
  misc_feature: HEFZJCU01A0BZO.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactgttgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggac

SEQ ID NO: 452713 - DNA, 513 bp, Homo sapiens
  misc_feature: HEFZJCU01BR5KB.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagccttagaggcgaggacacggcagtgtattactgtgcgagagatcgacatgactacgggaaagcttttgatctctggggccaagggacactggtcaccgtctcttcagcctccaccaacgggcccagtccggtccttcccccgtggccgccctgctccaggag

SEQ ID NO: 452714 - DNA, 485 bp, Homo sapiens
  misc_feature: HEFZJCU01CS1YI.49.8.A08.1.454.heavy.3.raw
agtcgagagacacgaccggtgctcgatttagcatactctacaggggctgggagaggagcccagcactagaagtcggcggtgtttccattcggtgatcagcactgaacacagaggactcaccatggagtttgggctgagcgtggttttccgtcgttaggcgtcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtaattactgtgcaacttaatcaac

SEQ ID NO: 452715 - DNA, 518 bp, Homo sapiens
  misc_feature: HEFZJCU01C0A6I.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttccccctggcaccctcctccagagcacctctgggggcacagcggcctgggctgcctggtcaaggactacttcctagagacacg

SEQ ID NO: 452716 - DNA, 402 bp, Homo sapiens
  misc_feature: HEFZJCU01ARPNH.13.72.G06.1.454.heavy.3.raw
tcacgtactacacgaccggtgctcgatttagctacgactgcaagggaaaggggctgcagtgggtcgccactattggtgataatggcagaaacatttactacgcagactccgtgaggggccgcttcaccatctccagagacaattcacggaacacattgtttttacaattgtcggcctgcgggccgaggacacggccaaatatttttgtgtaaaggatcaatataccagtttggttcgaagtccgtggccttttgactcctggggccagggaaccctggtcaccgtctcctcagcttccaccaagggcccatcggtcttccccctggcgccctgctccaggagcacctctgggggcacagcggccctgggctgcctggtcaaggactacttcctagtacgtga

SEQ ID NO: 452717 - DNA, 527 bp, Homo sapiens
  misc_feature: HEFZJCU01BYZFL.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctcggcaccctcctccagagcacctctgggggcacagcggccctgggctgcctggtcaaggactacttcccatactcgta

SEQ ID NO: 452718 - DNA, 526 bp, Homo sapiens
  misc_feature: HEFZJCU01AU0CB.48.66.F11.1.454.heavy.3.raw
agtatacatacacgaccggtgctcgatttagtcacgcgagaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgcttatttttgtccggtggttcgacccctggggccagggaaccctggtcaccgtctcctcacgcctccaaccg

SEQ ID NO: 452719 - DNA, 528 bp, Homo sapiens
  misc_feature: HEFZJCU01EI6UP.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccacgggaaccctggtcaccgtctcctcagcctccacc

SEQ ID NO: 452720 - DNA, 525 bp, Homo sapiens
  misc_feature: HEFZJCU01CHQVC.47.6.A06.1.454.heavy.3.raw
agctcacgtacacgaccggtgctcgatttagatctactgacagcacacaaggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttggataactggggccaggggatccgtggtcaccgtctcctcagcctccaccac

SEQ ID NO: 452721 - DNA, 516 bp, Homo sapiens
  misc_feature: HEFZJCU01ERK7N.53.32.C10.1.454.heavy.3.raw
cgcgtatacacacgaccggtgctcgatttagtatagacatcaacacacaaaggggctgggagaggagcccagcactgggattccgaggtgtttccattcagtgatctgcactgaacacagaggactcgccatggagtttgggctgagctgggttttccttgttgctattttaaaaggtgtccagtgtgaagttcacctggtggagtccgggggaggcttggtccggcctgggggttccctgagactctcctgtggagcctctaggttcaccttcagtagtaatcacatgacctgggtccgccaggctccagggaaggggctggattgggtctcagttatttatagcactggtacgacatactacgcagactccgtgaggggccgatttaccatctccagagacaactccaagagcacgttgtatcttcagatgaacagcctgagacctgcggacacggctgtctattactgtgcgaccgaaacacgtggatatagtggctacgattttggcttcgg

SEQ ID NO: 452722 - DNA, 519 bp, Homo sapiens
  misc_feature: HEFZJCU01A00RD.14.41.D08.1.454.heavy.3.raw
  modified_base (487)..(487): a, c, t, g, unknown or other
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaacccgtggtcaccgtctcttcagcctccaccaagggcccatcggtcttcccctggcnccctcctccaagagcacctctggggcacagcc

SEQ ID NO: 452723 - DNA, 503 bp, Homo sapiens
  misc_feature: HEFZJCU01CGB8Y.17.25.C03.1.454.heavy.3.raw
  modified_base (458)..(458): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaatactggtgtcacagtgtcttcacccatcctccgggacagacttaccatgaccacgaactcctccataaacacagcctacatggagttgaggagcctgacatctgacgatacggcgtctattactgtgcgagngtcccacgatccggtgagcctacggcagcggcctttggacttgtc

SEQ ID NO: 452724 - DNA, 525 bp, Homo sapiens
  misc_feature: HEFZJCU01A3PJ8.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctcggcaccctcctccaagagcacctctgggggcacagcc

SEQ ID NO: 452725 - DNA, 522 bp, Homo sapiens
  misc_feature: HEFZJCU01CKX1T.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgatttcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 452726 - DNA, 482 bp, Homo sapiens; identical to SEQ ID NO: 448987
  misc_feature: HEFZJCU01E0L4R.10.35.D02.1.454.heavy.3.raw

SEQ ID NO: 452727 - DNA, 512 bp, Homo sapiens
  misc_feature: HEFZJCU01DEF6C.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 452728 - DNA, 488 bp, Homo sapiens; identical to SEQ ID NO: 447495
  misc_feature: HEFZJCU01DULVK.22.86.H09.1.454.heavy.3.raw

SEQ ID NO: 452729 - DNA, 512 bp, Homo sapiens; identical to SEQ ID NO: 450914
  misc_feature: HEFZJCU01A4HPX.15.67.G01.1.454.heavy.3.raw

SEQ ID NO: 452730 - DNA, 531 bp, Homo sapiens
  misc_feature: HEFZJCU01BTSCE.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtcaccgt

SEQ ID NO: 452731 - DNA, 514 bp, Homo sapiens; identical to SEQ ID NO: 451806
  misc_feature: HEFZJCU01C0QUT.19.67.G01.1.454.heavy.3.raw

SEQ ID NO: 452732 - DNA, 524 bp, Homo sapiens
  misc_feature: HEFZJCU01DJF0H.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacgacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttcccctggcaccctcctccaagagcacctctgggggcacagcc

SEQ ID NO: 452733 - DNA, 530 bp, Homo sapiens
  misc_feature: HEFZJCU01CRKOK.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgctgtcagtggaattgactactggggccagggaaccctggtcaccgtctcctcagcctccaccaaggg

SEQ ID NO: 452734 - DNA, 506 bp, Homo sapiens; identical to SEQ ID NO: 445864
  misc_feature: HEFZJCU01AQ26J.13.37.D04.1.454.heavy.3.raw

SEQ ID NO: 452735 - DNA, 549 bp, Homo sapiens
  misc_feature: HEFZJCU01CKQXE.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacagtttgggggagtttatcgacgaaacgggggggtacgtaaccgtacgtacg

SEQ ID NO: 452736 - DNA, 520 bp, Homo sapiens
  misc_feature: HEFZJCU01AKRK6.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcgccctgctccaggagcacctccgagagcacagcggccctgggctgcctggtcaaggactacttccagacgtatcac

SEQ ID NO: 452737 - DNA, 464 bp, Homo sapiens; identical to SEQ ID NO: 445533
  misc_feature: HEFZJCU01AL8KF.19.10.A10.1.454.heavy.3.raw

SEQ ID NO: 452738 - DNA, 480 bp, Homo sapiens; identical to SEQ ID NO: 445011
  misc_feature: HEFZJCU01EMOQ8.22.36.D03.1.454.heavy.3.raw

SEQ ID NO: 452739 - DNA, 501 bp, Homo sapiens
  misc_feature: HEFZJCU01EF80G.7.85.H08.1.454.heavy.3.raw
cgtgtctctacacgaccggtgctcgatttagtatcactcagtcgcgggggctctcagagaggtgccttagacctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccgggaggggacgtatgacc

SEQ ID NO: 452740 - DNA, 507 bp, Homo sapiens
  misc_feature: HEFZJCU01BMLOY.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaatggacagcctgagagtcgaagacacggctgtgtattactgtgtgtctctgacgcctcggccggaccttggctttcg

SEQ ID NO: 452741 - DNA, 390 bp, Homo sapiens
  misc_feature: HEFZJCU01EJ0FN.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctgacgccctgctccaggagcacctccgagagcacagcggccctgggctgcctggtcaaggactacttccgagtagtaca

SEQ ID NO: 452742 - DNA, 535 bp, Homo sapiens
  misc_feature: HEFZJCU01CND2T.48.13.B02.1.454.heavy.3.raw
agtatacatacacgaccggtgctcgatttagtctagcgacttccgcggggctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgagagaatcctggggaccggccgtcttcgggggccagggaacactggttatcgtctcttcacg

SEQ ID NO: 452743 - DNA, 520 bp, Homo sapiens
  misc_feature: HEFZJCU01CBWHS.53.58.F03.1.454.heavy.3.raw
cgcgtatacacacgaccggtgctcgatttagtctgatcgagaagggaaaggggatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctgttggctccatcattcattatttctggagctgggtccggcagcccccagggaagggactggagtggattgggtatgtctattacaccgggaccacccactacaaccccctccctcaagagtcgagtcaccatatcagtagacacgtccaggaaccagttctccctgaagctgagctctgcgaccgctgcggacacggccgtgtattattgtgcgagagttagatttgatactggtgcagccgtacgggggtcctggttcgaccctggggccatggaaccctggtcaccgtctcctcag

SEQ ID NO: 452744 - DNA, 521 bp, Homo sapiens; identical to SEQ ID NO: 450527
  misc_feature: HEFZJCU01A3MB0.12.40.D07.1.454.heavy.3.raw

SEQ ID NO: 452745 - DNA, 516 bp, Homo sapiens
  misc_feature: HEFZJCU01A7YC6.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccagcggagtccaagtacttccg

SEQ ID NO: 452746 - DNA, 499 bp, Homo sapiens
  misc_feature: HEFZJCU01BA0M2.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggccatcggtcttcccctggcgccctgctccaggagcacctccgagagcacagcggccctgggctgcctggtcaaggactacttcctacgtcgtat

SEQ ID NO: 452747 - DNA, 512 bp, Homo sapiens; identical to SEQ ID NO: 446702
  misc_feature: HEFZJCU01C7OPZ.14.25.C03.1.454.heavy.3.raw

SEQ ID NO: 452748 - DNA, 516 bp, Homo sapiens
  misc_feature: HEFZJCU01CK0A8.13.76.G10.1.454.heavy.3.raw
tcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctggagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctgggccaagggaccg

SEQ ID NO: 452749 - DNA, 379 bp, Homo sapiens; identical to SEQ ID NO: 444450
  misc_feature: HEFZJCU01BRIFS.47.77.G11.1.454.heavy.3.raw

SEQ ID NO: 452750 - DNA, 522 bp, Homo sapiens
  misc_feature: HEFZJCU01D3S8Y.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggccaccctcctccaagagcacctctgggggcacacg

SEQ ID NO: 452751 - DNA, 489 bp, Homo sapiens
  misc_feature: HEFZJCU01D0I1Z.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggctgagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttcccatactcgta

SEQ ID NO: 452752 - DNA, 484 bp, Homo sapiens
  misc_feature: HEFZJCU01BIEXU.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 452753 - DNA, 512 bp, Homo sapiens
  misc_feature: HEFZJCU01AP7WU.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgtttctaggtcggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccac

SEQ ID NO: 452754 - DNA, 379 bp, Homo sapiens; identical to SEQ ID NO: 444450
  misc_feature: HEFZJCU01C122S.47.77.G11.1.454.heavy.3.raw

SEQ ID NO: 452755 - DNA, 432 bp, Homo sapiens; identical to SEQ ID NO: 444920
  misc_feature: HEFZJCU01A2LBT.11.39.D06.1.454.heavy.3.raw

SEQ ID NO: 452756 - DNA, 501 bp, Homo sapiens; identical to SEQ ID NO: 445027
  misc_feature: HEFZJCU01DQ5FY.26.23.C01.1.454.heavy.3.raw

SEQ ID NO: 452757 - DNA, 527 bp, Homo sapiens; identical to SEQ ID NO: 446200
  misc_feature: HEFZJCU01EYX74.7.70.G04.1.454.heavy.3.raw

SEQ ID NO: 452758 - DNA, 427 bp, Homo sapiens; identical to SEQ ID NO: 444708
  misc_feature: HEFZJCU01BHB4K.9.34.D01.1.454.heavy.3.raw

SEQ ID NO: 452759 - DNA, 499 bp, Homo sapiens
  misc_feature: HEFZJCU01D87US.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggcctgggctgcctggtcaaggactactccacta

SEQ ID NO: 452760 - DNA, 500 bp, Homo sapiens
  misc_feature: HEFZJCU01EYSEP.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagattttctatagaggtgacgtacgggggcgttcg

SEQ ID NO: 452761 - DNA, 522 bp, Homo sapiens
  misc_feature: HEFZJCU01BK6DD.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgtgggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 452762 - DNA, 324 bp, Homo sapiens; identical to SEQ ID NO: 444475
  misc_feature: HEFZJCU01B1S4C.18.17.B06.1.454.heavy.3.raw

SEQ ID NO: 452763 - DNA, 508 bp, Homo sapiens
  misc_feature: HEFZJCU01AVMI4.9.78.H01.1.454.heavy.3.raw
tgatacgtctcacgaccggtgctcgatttagtgtgagtagtttgggtttggggaggcttggtcaagcctggagggtccctgtgactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 452764 - DNA, 515 bp, Homo sapiens
  misc_feature: HEFZJCU01EFX4T.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaacctgagagtcgaagacacggccgtatattactgtgcgagacatgacttcggtgacccctggggccagggaaccctggtcaccgtctcctcagcctccaccaagggcccatcggtcttcccctggcgccctgctccaggagcacctccgagagcacagcggccctgggctgcctggtcaaggactacttccagacgt

SEQ ID NO: 452765 - DNA, 506 bp, Homo sapiens
  misc_feature: HEFZJCU01DJXPR.48.74.G08.1.454.heavy.3.raw
agtatacatacacgaccggtgctcgatttagtagctctatcaggggaggtctgggagaggagccccagccctgagattcccaggtgtttccattcagtgatcagcactgaacacagaggactcaccatggagttgggactgagctggattttcctttggctcttttaacaggtgtccagtgtgaagtgcagctggtggagtctgggggaggcttggtacagcccggcaggtccctgagactctcctgtgcagcctctggattcatctttggtgattatgccatgcactgggtccggcgaattccagggaaggcctggagtgggtctcaggtattagttgggatggtgacagtataggctatgcggactctgtgaggggccgattcaccatcaccagggaaacgccaataactccctgtgtctacaaatgaacaatctgagacctgaagacacggccttgtatttttgtgtaaaagatattctccgacaattatggtcatcgtgggt

SEQ ID NO: 452766 - DNA, 488 bp, Homo sapiens; identical to SEQ ID NO: 444617
  misc_feature: HEFZJCU01D12T0.4.6.A06.1.454.heavy.3.raw

SEQ ID NO: 452767 - DNA, 491 bp, Homo sapiens
  misc_feature: HEFZJCU01A4DOY.48.20.B09.1.454.heavy.3.raw
agtatacatacacgaccggtgctcgatttagtgtagtgtgaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctcggcgccctgctccaggagcacctccgacgagcacagcggccctgggctgcctggtcaaggactacttcctatgtatact

SEQ ID NO: 452768 - DNA, 380 bp, Homo sapiens
  misc_feature: HEFZJCU01D1C2Q.3.70.G04.1.454.heavy.3.raw
agacgcactccacgaccggtgctcgatttagtgtagtgtgaagggaaaggggccggagtgggtctcaattatttatggcgatggtagtacgtactacgcagactccgtgcaggaccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 452769 - DNA, 501 bp, Homo sapiens
  misc_feature: HEFZJCU01DCLMH.49.21.B10.1.454.heavy.3.raw
agtcgagagacacgaccggtgctcgatttagtgtcgtcgcaaggggctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaacagcctgaaagttgacgacacgggtctttttactgtgcgcctggaagcagtggctggccacatgatgctttt

SEQ ID NO: 452770 - DNA, 423 bp, Homo sapiens
  misc_feature: HEFZJCU01D06PU.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatggaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 452771 - DNA, 399 bp, Homo sapiens; identical to SEQ ID NO: 444863
  misc_feature: HEFZJCU01DH68Z.4.77.G11.1.454.heavy.3.raw

SEQ ID NO: 452772 - DNA, 514 bp, Homo sapiens
  misc_feature: HEFZJCU01EPGGX.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtggatctcacgtatcaatcctgatggcagtgttataaattatgcggactccgtggaggggccgattcagcatctccagagacaacggcaaggagtatactgtatctaggaaatgaacaatctgagagtcgacgatacggctgtctatcattgtgttttcgatgccttcggtccgcgggacttcgtggggccagggtacccg

SEQ ID NO: 452773 - DNA, 488 bp, Homo sapiens; identical to SEQ ID NO: 445455
  misc_feature: HEFZJCU01ESWW4.16.67.G01.1.454.heavy.3.raw

SEQ ID NO: 452774 - DNA, 396 bp, Homo sapiens; identical to SEQ ID NO: 444433
  misc_feature: HEFZJCU01CTACJ.47.59.F04.1.454.heavy.3.raw

SEQ ID NO: 452775 - DNA, 501 bp, Homo sapiens
  misc_feature: HEFZJCU01BOFDA.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactggactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 452776 - DNA, 518 bp, Homo sapiens; identical to SEQ ID NO: 444718
  misc_feature: HEFZJCU01ADD6I.9.34.D01.1.454.heavy.3.raw

SEQ ID NO: 452777 - DNA, 481 bp, Homo sapiens; identical to SEQ ID NO: 446362
  misc_feature: HEFZJCU01EFAVU.19.67.G01.1.454.heavy.3.raw

SEQ ID NO: 452778 - DNA, 513 bp, Homo sapiens
  misc_feature: HEFZJCU01EDR0Y.49.26.C04.1.454.heavy.3.raw
agtcgagagacacgaccggtgctcgatttagtctagcgactttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttcgacctac

SEQ ID NO: 452779 - DNA, 523 bp, Homo sapiens
  misc_feature: HEFZJCU01ERUR4.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctcggcgccctcgctccaggagcacctccgagagcacagcggccctgggcctgcctggtcaggactacttcctacg

SEQ ID NO: 452780 - DNA, 516 bp, Homo sapiens
  misc_feature: HEFZJCU01AWOAM.4.87.H10.1.454.heavy.3.raw
agcactgtagcacgaccggtgctcgatttagcagtactgcgttgggtttggggctgaagtgaggaagcctggggcctcagtgaaggtctcctgcaagacttctggatacaccttcgccggctactatatgcactggattcgacaggcccctggacaagggcttgagtggatggggtggatcaacccttacagtggtgtcacaaactatgcacagaagtttcagggctgggtcaccgtgaccagggacacgtccgtcagcacagtttacatggaactgaggaaactgagatctgacgacacggccgtctactactgtgcgagagggtacacggttataccatctgcgctagacttcgatattttgaaaggccatcattggtacttcgatctctggggccgtggcaccctggtcactgtctcctcagcctccaccaagggcccatcggtcttccccctggcaccctcctcccaagagcacctctgggggcacagcggccctgggctgcctggtcagga

SEQ ID NO: 452781 - DNA, 515 bp, Homo sapiens; identical to SEQ ID NO: 449376
  misc_feature: HEFZJCU01A3TVZ.11.13.B02.1.454.heavy.3.raw

SEQ ID NO: 452782 - DNA, 495 bp, Homo sapiens
  misc_feature: HEFZJCU01BQFNJ.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaggactac

SEQ ID NO: 452783 - DNA, 537 bp, Homo sapiens
  misc_feature: HEFZJCU01A44CL.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggggagccctggtccaccg

SEQ ID NO: 452784 - DNA, 437 bp, Homo sapiens; identical to SEQ ID NO: 444603
  misc_feature: HEFZJCU01AUKX6.3.21.B10.1.454.heavy.3.raw

SEQ ID NO: 452785 - DNA, 487 bp, Homo sapiens
  misc_feature: HEFZJCU01CMROX.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactactccacgtgagct

SEQ ID NO: 452786 - DNA, 477 bp, Homo sapiens
  misc_feature: HEFZJCU01AE5XY.12.81.H04.1.454.heavy.3.raw
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttcccctcggcgccctgctccaggagcacctccgagagcacagcggccctgggctgcctggtcaaggactacttcctacgtcgtat

SEQ ID NO: 452787 - DNA, 535 bp, Homo sapiens
  misc_feature: HEFZJCU01CRU7E.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctgggccaagggacgctggtcaccgtctcttcagcctccaccaagggcccatcggtcttcccctggcaccctcctccaagagcacctctggggcacagcc

SEQ ID NO: 452788 - DNA, 508 bp, Homo sapiens; identical to SEQ ID NO: 446002
  misc_feature: HEFZJCU01BDW8J.9.78.H01.1.454.heavy.3.raw

SEQ ID NO: 452789 - DNA, 471 bp, Homo sapiens; identical to SEQ ID NO: 444988
  misc_feature: HEFZJCU01BVEE4.48.1.A01.1.454.heavy.3.raw

SEQ ID NO: 452790 - DNA, 400 bp, Homo sapiens
  misc_feature: HEFZJCU01ATW1C.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccaggggactccctggtcgccgtcggctcagcctccaccaacgggcccatcggtccttcccctggcgccctgctccaggagcacctccgagagcacagccggccctgggctgcctggtcaaggactacttcctacgtgagct

SEQ ID NO: 452791 - DNA, 514 bp, Homo sapiens; identical to SEQ ID NO: 449003
  misc_feature: HEFZJCU01A5NZM.4.57.F02.1.454.heavy.3.raw

SEQ ID NO: 452792 - DNA, 498 bp, Homo sapiens
  misc_feature: HEFZJCU01CRR6N.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgatgcctttgatatgtggggccaagggacaatggtcaccgtctt

SEQ ID NO: 452793 - DNA, 312 bp, Homo sapiens; identical to SEQ ID NO: 444415
  misc_feature: HEFZJCU01CWEKY.7.10.A10.1.454.heavy.3.raw

SEQ ID NO: 452794 - DNA, 512 bp, Homo sapiens; identical to SEQ ID NO: 449104
  misc_feature: HEFZJCU01AINRF.11.13.B02.1.454.heavy.3.raw

SEQ ID NO: 452795 - DNA, 408 bp, Homo sapiens
  misc_feature: HEFZJCU01CSI0B.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaagaagacggaccgctggacgaggagccagaggagaatcactactttgactactggggccagggaagactggtcaccgtctcctccgcctccaccaagggcccatcggtcttccccctggcaccctcctccaagagcacctctggggcacagcgccctgggctgcctggtcaaggactacttcctcgtagcact

SEQ ID NO: 452796 - DNA, 505 bp, Homo sapiens
  misc_feature: HEFZJCU01CFQRG.48.34.D01.1.454.heavy.3.raw
agtatacatacacgaccggtgctcgatttagatcgtctgtgttgggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggta

SEQ ID NO: 452797 - DNA, 531 bp, Homo sapiens
  misc_feature: HEFZJCU01CCOBV.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaacccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactggggccagggaaccctggtcaccgtctcctcagcctccaccaaggg

SEQ ID NO: 452798 - DNA, 498 bp, Homo sapiens; identical to SEQ ID NO: 449564
  misc_feature: HEFZJCU01AYQJ2.12.55.E11.1.454.heavy.3.raw

SEQ ID NO: 452799 - DNA, 482 bp, Homo sapiens; identical to SEQ ID NO: 451792
  misc_feature: HEFZJCU01E1EY1.19.71.G05.1.454.heavy.3.raw

SEQ ID NO: 452800 - DNA, 513 bp, Homo sapiens; identical to SEQ ID NO: 451379
  misc_feature: HEFZJCU01C16ZH.15.23.C01.1.454.heavy.3.raw

SEQ ID NO: 452801 - DNA, 483 bp, Homo sapiens; identical to SEQ ID NO: 444924
  misc_feature: HEFZJCU01D5CZF.10.35.D02.1.454.heavy.3.raw

SEQ ID NO: 452802 - DNA, 508 bp, Homo sapiens
  misc_feature: HEFZJCU01A5UF1.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcgggtcatgttttagaagttggggcttttgaccactggggccagggaaccctggtcaccgtctcttcagcctccaccaagggcccatcggtcttccccctggcaccctcctccaagagcacctctgggggcacagcggccctgggctgcctggtcaaggactacttccgtactagacg

SEQ ID NO: 452803 - DNA, 503 bp, Homo sapiens
  misc_feature: HEFZJCU01EFCYA.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccatgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactgggccagggaaccctggtcatcgtctcctcagcctccaccaaggcccatcggtcttcccctggcaccctcctccaagagcacctctgggggcacagcggcctgggctgcctggtcaaggactacttccgagtagtaca

SEQ ID NO: 452804 - DNA, 524 bp, Homo sapiens; identical to SEQ ID NO: 445902
  misc_feature: HEFZJCU01CL4YF.9.78.H01.1.454.heavy.3.raw

SEQ ID NO: 452805 - DNA, 530 bp, Homo sapiens
  misc_feature: HEFZJCU01BAOT3.12.40.D07.1.454.heavy.3.raw
  modified_base (526)..(526): a, c, t, g, unknown or other
atacgacgtacacgaccggtgctcgatttagtgatagagcgtaacaacagagggctcaccatggagtttgggctgagcggtcggtttcgtctaaggcgtctttaagtaaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaaagaacaccctttatctgcaaaatagacagcctgagaccagacgacacggctgtctattattgcgcgagagagacacacgaacctactggccaatactatgggggcttgttctgggggcagggggaccctggtcatcgtctccccagccctccaccaagggcccatcggtctttccccnggcg

SEQ ID NO: 452806 - DNA, 507 bp, Homo sapiens; identical to SEQ ID NO: 450163
  misc_feature: HEFZJCU01AP3RN.16.21.B10.1.454.heavy.3.raw

SEQ ID NO: 452807 - DNA, 392 bp, Homo sapiens; identical to SEQ ID NO: 444682
  misc_feature: HEFZJCU01CDSFA.16.70.G04.1.454.heavy.3.raw

SEQ ID NO: 452808 - DNA, 506 bp, Homo sapiens; identical to SEQ ID NO: 444713
  misc_feature: HEFZJCU01CCCTC.5.41.D08.1.454.heavy.3.raw

SEQ ID NO: 452809 - DNA, 507 bp, Homo sapiens
  misc_feature: HEFZJCU01A1IJ6.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgccctggtcaaggactacttcctatgtatact

SEQ ID NO: 452810 - DNA, 507 bp, Homo sapiens
  misc_feature: HEFZJCU01C5GYX.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccagagcacctctggggcacagcggcctggctgcctggtcaggactacttcccatac

SEQ ID NO: 452811 - DNA, 534 bp, Homo sapiens
  misc_feature: HEFZJCU01EVY1C.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactacttccgtatctctcgc

SEQ ID NO: 452812 - DNA, 400 bp, Homo sapiens; identical to SEQ ID NO: 444452
  misc_feature: HEFZJCU01EGNSD.47.24.C02.1.454.heavy.3.raw

SEQ ID NO: 452813 - DNA, 505 bp, Homo sapiens
  misc_feature: HEFZJCU01AZUL5.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacaccgtccatcaacacagcctacatggaactgaggagcctaagatctgacgacacggccgtttattattgtgcaataagaattgcaaacgatgcttttgatatgtggggccaagggactacg

SEQ ID NO: 452814 - DNA, 505 bp, Homo sapiens
  misc_feature: HEFZJCU01BAW9R.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccagagcacctctgggggcacagcggccctgggctgcctggtcaaggactacttccgagtagtaca

SEQ ID NO: 452815 - DNA, 500 bp, Homo sapiens; identical to SEQ ID NO: 445720
  misc_feature: HEFZJCU01EYE23.3.20.B09.1.454.heavy.3.raw

SEQ ID NO: 452816 - DNA, 465 bp, Homo sapiens
  misc_feature: HEFZJCU01BBQ9Z.48.78.H01.1.454.heavy.3.raw
agtatacatacacgaccggtgctcgatttagtgtgagtagtttgggtttggggagctctgagagaggagccttaggcctcgattccaaggcctatccacttggtgatcagcactgagcaccgaggattcaccttggaactggggctccgctgggttttccttgttaatgttttagaaggtgtccagtgtgaggtgcagttggtggagtctgggggaggcctggtcaagtcgggggggtccctgagagtctcttgtgcagcctctagactcagtttcaatcaatgagacttggatttcctagtgtcactgcaatatggacgtctggggccaagggaccacggtcaccgtctcgtcagcttccaccaagggcccatcggtcttccccctggcgccctgctccaggagcacctctgggggcacagcggccctgggctgcctggtcaaggactacttcctatgtatact

SEQ ID NO: 452817 - DNA, 526 bp, Homo sapiens
  misc_feature: HEFZJCU01DBIDR.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggccatcggtcttcccctggcgccctgctccaggagcacctccgagagcaccagcggccctcgggc

SEQ ID NO: 452818 - DNA, 507 bp, Homo sapiens
  misc_feature: HEFZJCU01CFW2H.49.5.A05.1.454.heavy.3.raw
agtcgagagacacgaccggtgctcgatttagatagatagacaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggcaggcaacgattactacccgaaggactactggggccac

SEQ ID NO: 452819 - DNA, 486 bp, Homo sapiens
  misc_feature: HEFZJCU01D0FKS.49.87.H10.1.454.heavy.3.raw
agtcgagagacacgaccggtgctcgatttagcagtactgcgttgggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcaac

SEQ ID NO: 452820 - DNA, 508 bp, Homo sapiens
  misc_feature: HEFZJCU01AJGG0.11.67.G01.1.454.heavy.3.raw
  modified_base (439)..(439): a, c, t, g, unknown or other
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtnttccccctggcaccctcctccaagagcacctctgggggcacagcggcctgggctgcctgtcaagactac

SEQ ID NO: 452821 - DNA, 523 bp, Homo sapiens; identical to SEQ ID NO: 446270
  misc_feature: HEFZJCU01EAAGI.12.40.D07.1.454.heavy.3.raw

SEQ ID NO: 452822 - DNA, 508 bp, Homo sapiens
  misc_feature: HEFZJCU01B97A2.12.55.E11.1.454.heavy.3.raw
atacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggttatttcgattcg

SEQ ID NO: 452823 - DNA, 516 bp, Homo sapiens
  misc_feature: HEFZJCU01D3RXB.12.71.G05.1.454.heavy.3.raw
  modified_base (464)..(464): a, c, t, g, unknown or other
  modified_base (476)..(476): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctgcgccctgctccagngcacctccgagngcacagcgccctgggctgcctggtcaggactactcctacg

SEQ ID NO: 452824 - DNA, 484 bp, Homo sapiens; identical to SEQ ID NO: 451109
  misc_feature: HEFZJCU01AR76S.51.78.H01.1.454.heavy.3.raw

SEQ ID NO: 452825 - DNA, 506 bp, Homo sapiens
  misc_feature: HEFZJCU01EC09U.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctggctgcctggtcaaggactacttccgagtagtaca

SEQ ID NO: 452826 - DNA, 527 bp, Homo sapiens
  misc_feature: HEFZJCU01BFQG6.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtcatcgtctcc

SEQ ID NO: 452827 - DNA, 534 bp, Homo sapiens
  misc_feature: HEFZJCU01C8YZ9.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaccaggtggtccttacaatgaccaccatggaccctgtggacacagccacatatttctgtgcacactctataggagcacctggtagtctgccaaactgttcgacccctggggcccgggaaccctggtcaccgtctcctcacgcctccaccaagggcccatccggtcttcccctc

SEQ ID NO: 452828 - DNA, 500 bp, Homo sapiens
  misc_feature: HEFZJCU01EP6O5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactt

SEQ ID NO: 452829 - DNA, 504 bp, Homo sapiens
  misc_feature: HEFZJCU01CXRPB.17.10.A10.1.454.heavy.3.raw
  modified_base (467)..(467): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggaccacccccacgaacacagtctacatgcaactgacgagcctgagagctgacgacacggccgtctattactgtgcgagaatgttttctgtaaacntcgtacaatttgataggctctatggactggacttcgt

SEQ ID NO: 452830 - DNA, 526 bp, Homo sapiens
  misc_feature: HEFZJCU01DTSW9.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggcccctgggg

SEQ ID NO: 452831 - DNA, 381 bp, Homo sapiens; identical to SEQ ID NO: 444427
  misc_feature: HEFZJCU01A9VL4.9.53.E09.1.454.heavy.3.raw

SEQ ID NO: 452832 - DNA, 503 bp, Homo sapiens
  misc_feature: HEFZJCU01DXV7E.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggccgccctgctccaggagcacctccgagagcacagcggccctgggctgcctggtcaaggactacttcccgagcgacga

SEQ ID NO: 452833 - DNA, 391 bp, Homo sapiens
  misc_feature: HEFZJCU01D3Y2Q.15.77.G11.1.454.heavy.3.raw
tctacgtagccacgaccggtgctcgatttagctagtcactcaagggaaagggactggagtgtataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactactggggccagggaatcctggtcaccgtctcctcggcctccaccaagggcccatcggtcttccccctggcaccctcctccaagagcacctctgggggcacagcggccctgggctgcctggtcaaggactacttccgctacgtaga

SEQ ID NO: 452834 - DNA, 520 bp, Homo sapiens; identical to SEQ ID NO: 447034
  misc_feature: HEFZJCU01DSOSM.16.10.A10.1.454.heavy.3.raw

SEQ ID NO: 452835 - DNA, 492 bp, Homo sapiens; identical to SEQ ID NO: 444695
  misc_feature: HEFZJCU01C4JEZ.3.34.D01.1.454.heavy.3.raw

SEQ ID NO: 452836 - DNA, 531 bp, Homo sapiens
  misc_feature: HEFZJCU01EJYGV.40.70.G04.1.454.heavy.3.raw
tctagcgactcacgaccggtgctcgatttagtgtagtgtgaagggaaagggtctccgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaaggggaccacggttaccgtctcctcagcctccaccaagggcccatcggtcttcccctggcgccctgctccaggagcacctccgacgagcacagcggccctgggctgcctggtcaaggactacttccagtcgctaga

SEQ ID NO: 452837 - DNA, 460 bp, Homo sapiens
  misc_feature: HEFZJCU01DPP5I.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggccgccctgctccaggagcacctccgagagcacagcggccctgggctgcctggtcaaggactactccacgagta

SEQ ID NO: 452838 - DNA, 522 bp, Homo sapiens
  misc_feature: HEFZJCU01AVEO6.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccaggggaaccctggtcaccgtctcctcagcctccaccaaggg

SEQ ID NO: 452839 - DNA, 506 bp, Homo sapiens; identical to SEQ ID NO: 445243
  misc_feature: HEFZJCU01EVO5X.48.27.C05.1.454.heavy.3.raw

SEQ ID NO: 452840 - DNA, 531 bp, Homo sapiens
  misc_feature: HEFZJCU01DY4AI.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctgggggggcttggttaagcctggggggtccctcagactctcctgtgcaacctctggattcattttctctgacgcctggttgagctgggtccgccaggcctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattacgtgtaccacagatggggccaggactgcaaatggccgcgacgagttcgactacgtc

SEQ ID NO: 452841 - DNA, 379 bp, Homo sapiens; identical to SEQ ID NO: 444450
  misc_feature: HEFZJCU01DBKF3.47.77.G11.1.454.heavy.3.raw

SEQ ID NO: 452842 - DNA, 530 bp, Homo sapiens
  misc_feature: HEFZJCU01E14RC.40.81.H04.1.454.heavy.3.raw
tctagcgactcacgaccggtgctcgatttagtagtgtagattcgcgggtgtccttgggttttggggggaagaggaagactgacggtcctgccacagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtcgacgactacgggccatgtattactgtggaagagacgttggtggctaccgcggggctgaccactggggccagggaaccctggtcaccgtctcctcagcctccaccaagggcccatcggtcttccccctggcgccctgctccaggagcacctccgagagcacaggcggcccgtggg

SEQ ID NO: 452843 - DNA, 505 bp, Homo sapiens; identical to SEQ ID NO: 445474
  misc_feature: HEFZJCU01A9381.16.34.D01.1.454.heavy.3.raw

SEQ ID NO: 452844 - DNA, 535 bp, Homo sapiens
  misc_feature: HEFZJCU01DV5XI.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgtatctctcgc

SEQ ID NO: 452845 - DNA, 508 bp, Homo sapiens
  misc_feature: HEFZJCU01CKBYK.48.68.G02.1.454.heavy.3.raw
agtatacatacacgaccggtgctcgatttagtcgatagtgaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgccttttgatatgtggggccgaagggacaatggtcaccgtctt

SEQ ID NO: 452846 - DNA, 506 bp, Homo sapiens
  misc_feature: HEFZJCU01C5T3Q.52.34.D01.1.454.heavy.3.raw
cgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcattttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctgtcaaggactacttcctatacgatcg

SEQ ID NO: 452847 - DNA, 505 bp, Homo sapiens
  misc_feature: HEFZJCU01DTYJI.51.35.D02.1.454.heavy.3.raw
cgatcgtatacacgaccggtgctcgatttagcacacgatagttgggtttgggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctacg

SEQ ID NO: 452848 - DNA, 491 bp, Homo sapiens; identical to SEQ ID NO: 444803
  misc_feature: HEFZJCU01CBFI3.4.57.F02.1.454.heavy.3.raw

SEQ ID NO: 452849 - DNA, 512 bp, Homo sapiens
  misc_feature: HEFZJCU01BD2JM.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccaggcgggagttccaagtactcctttg

SEQ ID NO: 452850 - DNA, 491 bp, Homo sapiens; identical to SEQ ID NO: 444749
  misc_feature: HEFZJCU01DIQ7A.11.13.B02.1.454.heavy.3.raw

SEQ ID NO: 452851 - DNA, 487 bp, Homo sapiens
  misc_feature: HEFZJCU01BTFAW.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggcctgggctgcctggtcaaggactacttcctacgtcgtat

SEQ ID NO: 452852 - DNA, 503 bp, Homo sapiens
  misc_feature: HEFZJCU01D28V7.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctcccgagagcacagcggccctgggctgcctggtccaaggactacttcctatgtatact

SEQ ID NO: 452853 - DNA, 517 bp, Homo sapiens
  misc_feature: HEFZJCU01DNDYD.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgccctgctccaggagcacctccgagagcacagcggccctgggctgcctggtcaaggactacttcctatgtatacc

SEQ ID NO: 452854 - DNA, 396 bp, Homo sapiens; identical to SEQ ID NO: 444731
  misc_feature: HEFZJCU01DEQL8.18.61.F06.1.454.heavy.3.raw

SEQ ID NO: 452855 - DNA, 339 bp, Homo sapiens; identical to SEQ ID NO: 444436
  misc_feature: HEFZJCU01EN97X.47.38.D05.1.454.heavy.3.raw

SEQ ID NO: 452856 - DNA, 512 bp, Homo sapiens
  misc_feature: HEFZJCU01B5MHJ.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacggggcgtatactactgtacgaaggaggggggaaccgaggcggagttccaagtactccttt

SEQ ID NO: 452857 - DNA, 509 bp, Homo sapiens; identical to SEQ ID NO: 444586
  misc_feature: HEFZJCU01BCLCF.12.78.H01.1.454.heavy.3.raw

SEQ ID NO: 452858 - DNA, 528 bp, Homo sapiens
  misc_feature: HEFZJCU01D9SKL.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggccgcctgctccaggagcacctccgagacg

SEQ ID NO: 452859 - DNA, 526 bp, Homo sapiens
  misc_feature: HEFZJCU01DFUL6.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctggctgctcggtcgtacggacgtacttccgttactcctccgtctgagcgggcgtcggtcgacggacggcgac

SEQ ID NO: 452860 - DNA, 499 bp, Homo sapiens
  misc_feature: HEFZJCU01COMRZ.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgagggcctgaggtctgacgacacggcctctattattgtgcgagaattaatttcgttattgttctggtggtgtgtgttcaatgtttgacc

SEQ ID NO: 452861 - DNA, 505 bp, Homo sapiens
  misc_feature: HEFZJCU01D245X.17.31.C09.1.454.heavy.3.raw
cgtagactagcacgaccggtgctcgatttagacgtctcatcaaggaaggaagggctgtagttgatgtgagagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaagggcccatcggtcttcccctggccacctcctccaagagcacctctgggggcacagcggccctgggctgcctggtcaaggactacttccctagtctacg

SEQ ID NO: 452862 - DNA, 515 bp, Homo sapiens
  misc_feature: HEFZJCU01ETU94.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactgggccagggaaccctggtcatcgtctcctcagcctccaccaagggcccatcggtcttcccctggcaccctcctccaagagcacctctgggggcacagcggccctgggctgcctggtcaaggactacttccgagtagta

SEQ ID NO: 452863 - DNA, 540 bp, Homo sapiens
  misc_feature: HEFZJCU01BQ4XN.51.27.C05.1.454.heavy.3.raw
cgatcgtatacacgaccggtgctcgatttagacgcgatcgaagggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtcgtggggccaagggaccacggtcaccgtctccttagccctccaccaagggcccagtcggtccttccccctggccaccctcctccgaagacgcacctcgtc

SEQ ID NO: 452864 - DNA, 513 bp, Homo sapiens
  misc_feature: HEFZJCU01CKAV0.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcacctggtctacttcgatctc

SEQ ID NO: 452865 - DNA, 375 bp, Homo sapiens; identical to SEQ ID NO: 444459
  misc_feature: HEFZJCU01B4B3G.48.59.F04.1.454.heavy.3.raw

SEQ ID NO: 452866 - DNA, 505 bp, Homo sapiens
  misc_feature: HEFZJCU01DU0AG.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctcggcgccctgctcc

SEQ ID NO: 452867 - DNA, 509 bp, Homo sapiens
  misc_feature: HEFZJCU01EOE2D.18.50.E06.1.454.heavy.3.raw
  modified_base (424)..(424): a, c, t, g, unknown or other
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatnttcaaatgaacagcctgacagtcgacgacacggccatgtatttttgtgtcgagcgacccggggctcctcaatggctttcattacg

SEQ ID NO: 452868 - DNA, 519 bp, Homo sapiens
  misc_feature: HEFZJCU01DX6FK.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccttggggccagggaaccctggtcaccgtctcctcagcctccaccaagggcccatcggtcttcccctggcaccctcctccaagagcacctctgggggcacagcggccctgggctgcctggtcaaggactacttccgagtagtacac

SEQ ID NO: 452869 - DNA, 515 bp, Homo sapiens
  misc_feature: HEFZJCU01C0S42.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctattttgggccgtcggccgactactgggccgac

SEQ ID NO: 452870 - DNA, 485 bp, Homo sapiens
  misc_feature: HEFZJCU01AZH7L.10.85.H08.1.454.heavy.3.raw
catagtagtgcacgaccggtgctcgatttagtatcactcagtcgggggctgggaggcctggtccagccggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactacttccactactatg

SEQ ID NO: 452871 - DNA, 510 bp, Homo sapiens
  misc_feature: HEFZJCU01DGMTH.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcaccatactactttgactactggggccg

SEQ ID NO: 452872 - DNA, 513 bp, Homo sapiens
  misc_feature: HEFZJCU01ESC2J.48.10.A10.1.454.heavy.3.raw
agtatacatacacgaccggtgctcgatttagcgtcgatctcaggggagctctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccattttatttttgtgctagatctgaagaattaccagctgctgtgttcct

SEQ ID NO: 452873 - DNA, 528 bp, Homo sapiens
  misc_feature: HEFZJCU01D7ZWP.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttggataacgtggggccgaggggatcctggtcaccgtctcctcagcctccaccaac

SEQ ID NO: 452874 - DNA, 514 bp, Homo sapiens
  misc_feature: HEFZJCU01D4CEK.49.86.H09.1.454.heavy.3.raw
agtcgagagacacgaccggtgctcgatttagtgctatagacttgggtttgggggggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcggccg

SEQ ID NO: 452875 - DNA, 515 bp, Homo sapiens
  misc_feature: HEFZJCU01EZHDQ.48.33.C11.1.454.heavy.3.raw
agtatacatacacgaccggtgctcgatttagagtgagctcgttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgaccctggggccagggatacctggtctaccg

SEQ ID NO: 452876 - DNA, 524 bp, Homo sapiens; identical to SEQ ID NO: 445902
  misc_feature: HEFZJCU01A6VH8.9.78.H01.1.454.heavy.3.raw

SEQ ID NO: 452877 - DNA, 497 bp, Homo sapiens
  misc_feature: HEFZJCU01BI3LM.52.81.H04.1.454.heavy.3.raw
cgcagtacgacacgaccggtgctcgatttagtagtgtagattcgcggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccggaggacacggccacctatttctgtacgaaagaatacacacagctggacgagga

SEQ ID NO: 452878 - DNA, 477 bp, Homo sapiens; identical to SEQ ID NO: 444659
  misc_feature: HEFZJCU01B42AF.16.10.A10.1.454.heavy.3.raw

SEQ ID NO: 452879 - DNA, 487 bp, Homo sapiens; identical to SEQ ID NO: 445219
  misc_feature: HEFZJCU01EU0K2.10.85.H08.1.454.heavy.3.raw

SEQ ID NO: 452880 - DNA, 528 bp, Homo sapiens
  misc_feature: HEFZJCU01EWRFH.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccacg

SEQ ID NO: 452881 - DNA, 514 bp, Homo sapiens
  misc_feature: HEFZJCU01B0C6P.48.27.C05.1.454.heavy.3.raw
agtatacatacacgaccggtgctcgatttagacgcgatcgaagggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactattggttcggggagtctccgacccagccaactggttccgacccc

SEQ ID NO: 452882 - DNA, 517 bp, Homo sapiens; identical to SEQ ID NO: 445684
  misc_feature: HEFZJCU01A6975.9.34.D01.1.454.heavy.3.raw

SEQ ID NO: 452883 - DNA, 379 bp, Homo sapiens; identical to SEQ ID NO: 444450
  misc_feature: HEFZJCU01A9MHU.47.77.G11.1.454.heavy.3.raw

SEQ ID NO: 452884 - DNA, 506 bp, Homo sapiens
  misc_feature: HEFZJCU01DSI30.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctatactgtgttaggagttttacgattttggt

SEQ ID NO: 452885 - DNA, 316 bp, Homo sapiens; identical to SEQ ID NO: 444479
  misc_feature: HEFZJCU01CE6ZJ.47.84.H07.1.454.heavy.3.raw

SEQ ID NO: 452886 - DNA, 427 bp, Homo sapiens
  misc_feature: HEFZJCU01CIVUR.4.37.D04.1.454.heavy.3.raw
agcactgtagcacgaccggtgctcgatttagtagcatactgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatgga

SEQ ID NO: 452887 - DNA, 523 bp, Homo sapiens; identical to SEQ ID NO: 446270
  misc_feature: HEFZJCU01DFEK5.12.40.D07.1.454.heavy.3.raw

SEQ ID NO: 452888 - DNA, 500 bp, Homo sapiens
  misc_feature: HEFZJCU01CVSUP.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacaccccacgaacacagtctacatgcaactgacgagcctgagagctgacgacacggccgtctattactgtgcgagaatgttttctgtcatcgtacaatttgataggctctatggactggacttctc

SEQ ID NO: 452889 - DNA, 515 bp, Homo sapiens
  misc_feature: HEFZJCU01DDYNT.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtccagaaccagttctccctgacagtgagttatatgaccgccgcagacacggccgtgtattactgtgcgagagaggccgttattttaggaccagctagttaaaactcctactacggtctggacgtctggggcaggggaccaa

SEQ ID NO: 452890 - DNA, 395 bp, Homo sapiens; identical to SEQ ID NO: 444494
  misc_feature: HEFZJCU01BSQQV.47.46.E02.1.454.heavy.3.raw

SEQ ID NO: 452891 - DNA, 384 bp, Homo sapiens; identical to SEQ ID NO: 444454
  misc_feature: HEFZJCU01EBQML.11.61.F06.1.454.heavy.3.raw

SEQ ID NO: 452892 - DNA, 491 bp, Homo sapiens; identical to SEQ ID NO: 445899
  misc_feature: HEFZJCU01DLIH4.11.26.C04.1.454.heavy.3.raw

SEQ ID NO: 452893 - DNA, 484 bp, Homo sapiens
  misc_feature: HEFZJCU01AD24C.11.23.C01.1.454.heavy.3.raw
cgagagataccacgaccggtgctcgatttagtacacgtgattagggattgggggcagggtgtacacctgtggttctcgggactgccctttggctttggagatggttttctcgatggggggctggagtggcttgggcgctctagaaacaagtttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacgggtcatcgtctcctcagcctccaccaagggcccatcggtcttcccctggcaccctcctccaagagcacctctgggggcacagcggccctgggctgcctggtcaaggactactccgtatctctcg

SEQ ID NO: 452894 - DNA, 522 bp, Homo sapiens; identical to SEQ ID NO: 449550
  misc_feature: HEFZJCU01CGFMQ.12.40.D07.1.454.heavy.3.raw

SEQ ID NO: 452895 - DNA, 518 bp, Homo sapiens; identical to SEQ ID NO: 444718
  misc_feature: HEFZJCU01EIECU.9.34.D01.1.454.heavy.3.raw

SEQ ID NO: 452896 - DNA, 522 bp, Homo sapiens
  misc_feature: HEFZJCU01BLWRH.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttcccctcggcgccctgctccaggagcacctccgacgagcacagcggccctgggctgcctggtcaggactacttcctaccg

SEQ ID NO: 452897 - DNA, 538 bp, Homo sapiens
  misc_feature: HEFZJCU01D8ICR.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctcctcaagagtcgtgtcaccgtgtcaatagacacgtccaagaaccagttctccctgaggctgagctctgtgaccgccgcggacacggccgtgtatttctgtgcgagatcttcgtattttggagtggtaacccccttggcttacgtggggccaggggaaccctgggtcaccggtctcttcagtcctccaccaacgggccctacg

SEQ ID NO: 452898 - DNA, 518 bp, Homo sapiens; identical to SEQ ID NO: 444718
  misc_feature: HEFZJCU01C8MI7.9.34.D01.1.454.heavy.3.raw

SEQ ID NO: 452899 - DNA, 506 bp, Homo sapiens; identical to SEQ ID NO: 444696
  misc_feature: HEFZJCU01CKERP.16.34.D01.1.454.heavy.3.raw
